United States Patent
Ols et al.

(10) Patent No.: US 12,227,551 B2
(45) Date of Patent: Feb. 18, 2025

(54) MEMBRANE BOUND IL12 COMPOSITIONS AND METHODS FOR TUNABLE REGULATION

(71) Applicant: Obsidian Therapeutics, Inc., Cambridge, MA (US)

(72) Inventors: Michelle Lynn Ols, Northborough, MA (US); Vipin Suri, Belmont, MA (US); Dexue Sun, Cambridge, MA (US); Dan Jun Li, Cambridge, MA (US); Dhruv Kam Sethi, Westwood, MA (US); Abhishek Kulkarni, Brookline, MA (US); Benjamin J. Primack, Brookline, MA (US); James Storer, Medford, MA (US)

(73) Assignee: OBSIDIAN THERAPEUTICS, INC., Cambridge, MA (US)

( * ) Notice: Subject to any disclaimer, the term of this patent is extended or adjusted under 35 U.S.C. 154(b) by 903 days.

(21) Appl. No.: 17/413,512

(22) PCT Filed: Dec. 11, 2019

(86) PCT No.: PCT/US2019/065810
§ 371 (c)(1),
(2) Date: Jun. 11, 2021

(87) PCT Pub. No.: WO2020/123716
PCT Pub. Date: Jun. 18, 2020

(65) Prior Publication Data
US 2022/0056092 A1 Feb. 24, 2022

Related U.S. Application Data

(60) Provisional application No. 62/860,386, filed on Jun. 12, 2019, provisional application No. 62/815,408, filed on Mar. 8, 2019, provisional application No. 62/777,900, filed on Dec. 11, 2018.

(51) Int. Cl.
| | |
|---|---|
| *C07K 14/54* | (2006.01) |
| *A61K 39/00* | (2006.01) |
| *A61P 35/00* | (2006.01) |
| *C07K 14/725* | (2006.01) |
| *C07K 16/28* | (2006.01) |

(52) U.S. Cl.
CPC ...... *C07K 14/5434* (2013.01); *A61K 39/4611* (2023.05); *A61K 39/4631* (2023.05); *A61K 39/464412* (2023.05); *A61K 39/46444* (2023.05); *A61P 35/00* (2018.01); *C07K 14/7051* (2013.01); *C07K 16/2803* (2013.01); *A61K 2239/31* (2023.05); *A61K 2239/38* (2023.05); *A61K 2239/48* (2023.05); *C07K 2317/622* (2013.01); *C07K 2319/03* (2013.01); *C07K 2319/20* (2013.01); *C07K 2319/33* (2013.01)

(58) Field of Classification Search
CPC ...... A61K 39/46444; A61K 39/464412; A61K 39/4631; A61K 35/17; C07K 14/5434; C07K 2319/03; C07K 2319/33; A61P 35/00
See application file for complete search history.

(56) References Cited

U.S. PATENT DOCUMENTS

| | | | | |
|---|---|---|---|---|
| 11,241,485 B2 * | 2/2022 | Suri | ........... | C07K 14/5443 |
| 11,666,642 B2 * | 6/2023 | Suri | ........... | C07K 16/2809 |
| | | | | 424/85.2 |
| 2023/0074330 A1 * | 3/2023 | Suri | ........... | A61K 31/4985 |

FOREIGN PATENT DOCUMENTS

| | | |
|---|---|---|
| WO | 2017062953 | 4/2017 |
| WO | 2017180587 | 10/2017 |
| WO | 2018161017 | 9/2018 |
| WO | 2018161038 | 9/2018 |
| WO | 2018231759 | 12/2018 |
| WO | 2018237323 | 12/2018 |
| WO | 2019241315 | 12/2019 |

OTHER PUBLICATIONS

PCT/US2019/065810, International Search Report and Written Opinion, mailed Apr. 20, 2020, 11 pages.
PCT/US2019/065810, International Preliminary Report on Patentability, mailed Jun. 8, 2021, 7 pages.
33rd Annual Meeting & Pre-Conference Programs of the Society for Immunotherapy of Cancer (SITC 2018), Journal for Immunotherapy of Cancer, vol. 6, Nov. 6, 2018, pp. 1-205, XP021262326, DOI: 10.1186/S40425-018-0422-Y Abstracts P238, P721.
Suri et al., Small Molecule Regulated Cytokine Expression Enables Potent and Durable Responses to Engineered T-Cell Therapy, Blood: American Society of Hematology, vol. 132, Nov. 29, 2018, 3 pages.
EP Patent Application No. 19836302.0, Communication pursuant to Article 94(3) EPC, mailed Mar. 27, 2024, 5 pages.

* cited by examiner

*Primary Examiner* — Bao Q Li
(74) *Attorney, Agent, or Firm* — Kilpatrick Townsend & Stockton LLP

(57) ABSTRACT

The present disclosure provides regulatable biocircuit systems. Such systems provide modular and tunable protein expression systems in support of the discovery and development of therapeutic modalities.

18 Claims, No Drawings
Specification includes a Sequence Listing.

MEMBRANE BOUND IL12 COMPOSITIONS AND METHODS FOR TUNABLE REGULATION

CROSS REFERENCE TO RELATED APPLICATIONS

This application is a 35 U.S.C. § 371 National Stage filing of International Application No. PCT/US2019/065810, filed Dec. 11, 2019, which claims the benefit of priority to U.S. Provisional Application No. 62/777,900, filed Dec. 11, 2018, U.S. Provisional Application No. 62/815,408, filed Mar. 8, 2019, and U.S. Provisional Application No. 62/860,386, filed Jun. 12, 2019. The entire contents of the aforementioned applications are incorporated herein by reference in their entireties.

REFERENCE TO THE SEQUENCE LISTING

The instant application contains a Sequence Listing which has been submitted in ASCII format via EFS-Web and is hereby incorporated by reference in its entirety. Said ASCII copy, created Dec. 11, 2019, is named 268052-459201_SL.txt and is 1,659,278 bytes in size.

FIELD

The present disclosure relates to compositions and methods for immunotherapy. Provided in the present disclosure include polypeptides of biocircuit systems, effector modules, stimulus response elements (SREs), polynucleotides encoding the same, vectors and cells containing the polypeptides and/or polynucleotides for use in cancer immunotherapy. In one embodiment, the compositions comprise at least one destabilizing domains (DDs) which tune protein stability for at least one payload. In one embodiment, the compositions comprise a membrane-associated Interleukin 12 (IL12).

BACKGROUND

Gene therapy is revolutionizing medicine and offering new promise for the treatment of previously intractable conditions. However, current technologies do not allow titration of the timing or levels of target protein induction. This has rendered many potential gene therapy applications difficult or impossible to safely and effectively deploy.

One approach to regulated protein expression or function is the use of Destabilizing Domains (DDs).

Novel moieties utilizing DD technology as described herein can form the basis of a new class of cell and gene therapies that employ tunable and temporal control of gene expression and function. Such novel moieties are described by the present inventors as stimulus response elements (SREs) which act in the context of an effector module to complete a biocircuit arising from a stimulus and ultimately producing a signal or outcome. When properly formatted with a polypeptide payload, and when activated by a particular stimulus, e.g., a small molecule, biocircuit systems can be used to regulate transgene and/or protein levels either up or down by perpetuating a stabilizing signal or destabilizing signal. This approach has many advantages over existing methods of regulating protein function and/or expression, which are currently focused on top level transcriptional regulation via inducible promoters.

Utilization of the DD technology described herein with methods of regulating protein function and/or expression represent a significant improvement on existing gene therapy strategies, and can expand the universe of protein therapeutics that can be safely and effectively incorporated into gene therapy modalities, including applications that have previously been considered unsuitable for therapeutic use.

SUMMARY

The present disclosure provides novel protein domains displaying small molecule dependent stability. Such protein domains are called destabilizing domains (DDs). In the absence of its binding ligand, the DD is destabilizing and causes degradation of a payload fused to the DD (e.g., a protein of interest (POI), while in the presence of its binding ligand, the fused DD and payload can be stabilized, and its stability is dose dependent. These systems are further taught in International Publication WO2017/180587 (the contents of which are herein incorporated by reference in their entirety).

Provided herein is an effector module. The effector module comprises (a) a payload of interest which may include but is not limited to a membrane-associated Interleukin 12 (IL12) and (b) a stimulus response element (SRE) derived from a parent protein. The parent protein may be PDE5. The SRE may be responsive to or interacts with at least one stimulus.

Also provided herein is a modified cell comprising an effector module. The effector module comprises: (a) a payload of interest, said payload comprising a membrane-associated Interleukin 12 (IL12); and (b) a stimulus response element (SRE) derived from a parent protein, wherein the parent protein is PDE5, and wherein the SRE is responsive to or interacts with at least one stimulus.

In some embodiments, the effector module is a bicistronic effector module that comprises an amino acid sequence encoding the recombinant protein and an amino acid sequence encoding a second recombinant protein, wherein the second recombinant protein comprises a CD19 chimeric antigen receptor (CAR).

In some embodiments, the membrane-associated IL12 (mbIL12) may be a fusion protein. The fusion protein may include (a) Interleukin-12 subunit beta (p40); (b) Interleukin-12 subunit alpha (p35); (c) at least one linker; and (d) a transmembrane domain.

In some embodiments, the mbIL12 may further include an optional hinge domain. In some embodiments, the transmembrane domain comprises a hinge domain.

In some embodiments, the at least one linker is a GS-rich linker.

In some embodiments, an mbIL12 payload may further include a cytoplasmic tail domain.

In some embodiments, an mbIL12 payload comprises a shedding site.

In some embodiments, the effector module further comprises a signal sequence.

In some embodiments, the p40 may be SEQ ID NO. 434. In one aspect, the p35 may be SEQ ID NO. 464.

In some embodiments, the SRE of the effector module may be derived from PDE5. In one embodiment, the SRE may include amino acid 535-860 of SEQ ID NO: 1. The SRE may also include at least one mutation as compared to SEQ ID NO: 1.

In some embodiments, the SRE may include one mutation. In some embodiments, the mutation is a mutation at position R732. In one aspect, the mutation may be R732L.

In some embodiments, the SRE may include two mutations. In one aspect, the two mutations may be R732L and H653A.

The stimulus of the effector module may be vardenafil, sildenafil or tadalafil.

Also provided herein are compositions that include the effector modules described herein and a CAR.

In some embodiments, the effector module further comprises a CD19 chimeric antigen receptor (CAR).

Also provided herein is a modified cell described herein further comprising an amino acid sequence encoding a CD19 chimeric antigen receptor (CAR).

Also provided herein is the modified cell described herein further comprising a second recombinant protein comprising a CD19 chimeric antigen receptor (CAR).

In some embodiments, the CAR comprises (a) an extracellular moiety; (b) a transmembrane domain; (c) an intracellular signaling domain; and (d) optionally one or more co-stimulatory domains.

In some embodiments, the extracellular moiety is a single chain variable fragment (scFv).

In some embodiments, the intracellular signaling domain of the CD19 CAR is the signaling domain derived from T cell receptor CD3zeta.

In some embodiments, the cell is a T-cell. In one aspect, the T-cell is a tumor infiltrating lymphocyte (TIL).

Also provided herein is a pharmaceutical composition comprising the modified cell described herein and a pharmaceutically acceptable carrier.

Also provided herein is a nucleic acid molecule comprising a first polynucleotide, wherein said first polynucleotide encodes an effector module, wherein said effector module comprises: (a) a payload of interest, said payload comprising a membrane-associated Interleukin 12 (IL12); and (b) a stimulus response element (SRE) derived from a parent protein, wherein the parent protein is PDE5; and wherein the SRE is responsive to or interacts with at least one stimulus.

In some embodiments, the nucleic acid molecule further comprises a second polynucleotide that encodes a second recombinant protein comprising a CD19 chimeric antigen receptor (CAR).

Also provided herein is a vector comprising the nucleic acid molecule described herein. In some embodiments, the vector is a plasmid or lentiviral vector.

Also provided herein is a method of producing a modified cell comprising introducing into a cell: (i) a nucleic acid molecule comprising a first polynucleotide encoding an effector module, wherein said effector module comprises: (a) a payload of interest, said payload comprising a membrane-associated Interleukin 12 (IL12); and (b) at least one stimulus response element (SRE) derived from at least one parent protein, wherein the parent protein is PDE5; and wherein the SRE is responsive to or interacts with at least one stimulus. In some embodiments, the method further comprises introducing into the cell a second polynucleotide encoding a CD19 chimeric antigen receptor (CAR). In some embodiments, the cell is a T-cell. In one aspect, the T-cell is a tumor infiltrating lymphocyte (TIL).

Also provided herein is a method of regulating expression of an immunotherapeutic agent in a cell, comprising introducing into a cell: (i) a first polynucleotide encoding an effector module, wherein said effector module comprises: (a) a payload of interest, said payload comprising a membrane-associated Interleukin 12 (IL12); and (b) at least one stimulus response element (SRE) comprising a DD, wherein said DD is derived from a parent protein, wherein the parent protein is PDE5; and wherein the SRE is responsive to or interacts with at least one stimulus; and (ii) optionally a second polynucleotide encoding a CD19 chimeric antigen receptor (CAR); wherein the DD is stabilized in the presence of a stimulus and enables expression of the membrane-associated Interleukin 12 (IL12), and wherein expression of the membrane-associated Interleukin 12 (IL12) in the cell is significantly increased in the presence of the stimulus as compared to expression of the membrane-associated Interleukin 12 (IL12) in the absence of the stimulus. In some embodiments, the cell is a T-cell. In one aspect, the T-cell is a tumor infiltrating lymphocyte (TIL).

Also provided herein is a method for treating a subject by administering a therapeutically sufficient amount of modified cells or a pharmaceutical composition as described herein to a subject in need of an adoptive cell therapy, wherein the cell therapy is autologous or allogeneic; and wherein the subject has a hematological malignancy; a solid tumor; or a cancer.

DETAILED DESCRIPTION

The details of one or more embodiments of the disclosure are set forth in the accompanying description below. Although any materials and methods similar or equivalent to those described herein can be used in the practice or testing of the present disclosure, the preferred materials and methods are now described. Other features, objects and advantages of the disclosure will be apparent from the description. In the description, the singular forms also include the plural unless the context clearly dictates otherwise. Unless defined otherwise, all technical and scientific terms used herein have the same meaning as commonly understood by one of ordinary skill in the art to which this disclosure belongs. In the case of conflict, the present description will control.

I. Compositions

As used herein, a "biocircuit" or "biocircuit system" is defined as a circuit within or useful in biologic systems comprising a stimulus and at least one effector module responsive to a stimulus, where the response to the stimulus produces at least one signal or outcome within, between, as an indicator of, or on a biologic system. Biologic systems are generally understood to be any cell, tissue, organ, organ system or organism, whether animal, plant, fungi, bacterial, or viral. It is also understood that biocircuits may be artificial circuits which employ the stimuli or effector modules taught by the present disclosure and effect signals or outcomes in acellular environments such as with diagnostic, reporter systems, devices, assays or kits.

Effector Modules and SREs

The biocircuits of the present disclosure include at least one effector module. As used herein, an "effector module" is a single or multi-component construct or complex comprising at least (a) one or more stimulus response elements and (b) one or more payloads (e.g. proteins of interest (POIs)).

As used herein a "stimulus response element (SRE)" is a component of an effector module which is joined, attached, linked to or associated with one or more payloads of the effector module and in some instances, is responsible for the responsive nature of the effector module to one or more stimuli. As used herein, the "responsive" nature of an SRE to a stimulus may be characterized by a covalent or non-covalent interaction, a direct or indirect association or a structural or chemical reaction to the stimulus. Further, the response of any SRE to a stimulus may be a matter of degree or kind. The response may be a partial response. The response may be a reversible response. The response may ultimately lead to a regulated signal or output. Such output signal may be of a relative nature to the stimulus, e.g., producing a modulatory effect of between 1% and 100% or a factored increase or decrease such as 2-fold, 3-fold, 4-fold, 5-fold, 10-fold or more. In some embodiments, the SRE is a polypeptide fused to a polypeptide payload.

In some embodiments, the present disclosure provides methods for modulating protein expression, function or level. In some aspects, the modulation of protein expression, function or level refers to modulation of expression, function or level by at least about 20%, such as by at least about 30%, 40%, 50%, 60%, 70%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%.

Effector modules may be designed to include one or more payloads, one or more SREs, one or more cleavage sites, one or more signal sequences and one or more additional features including the presence or absence of one or more linkers.

In one embodiment, the effector module comprises at least one immunotherapeutic agent. In one embodiment, the effector modules comprise two or more immunotherapeutic agents which may be the same type such as two antibodies, or different types such as a CAR construct and a cytokine IL12. As a non-limiting example, the immunotherapeutic agent is a chimeric antigen receptor (CAR) or a variant or fragment thereof. As another non-limiting example, the immunotherapeutic agent is IL12.

Effector modules, including their SREs and payloads, may be nucleic acid-based, protein-based or a combination thereof. They may be in the form of DNA, RNA, mRNA, proteins, fusion proteins, or any combination of the foregoing. In one embodiment, the effector module is a fusion protein. In one embodiment, the effector module is encoded by nucleic acid, such as DNA.

Effector modules, including their SREs and payloads may individually, collectively or independently comprise peptides, polypeptides or proteins. At the protein level, such payload may be any natural or artificial peptide or polypeptide or fragment thereof.

Effector modules may be designed to operate in groups of one, two, three, four or more modules. When more than one effector module is utilized in a biocircuit, it is known as an effector module system of that biocircuit.

Destabilizing Domains

Destabilizing domains (DDs) are small protein domains that can be appended to a target protein of interest. The term destabilizing domain (DD) is interchangeable with the term drug responsive domain (DRD). DDs render the attached protein of interest unstable in the absence of a DD-binding ligand. However, when a specific small molecule ligand binds its intended DD as a ligand binding partner, the instability is reversed and protein function is restored. The conditional nature of DD stability allows a rapid and non-perturbing switch from stable protein to unstable substrate for degradation. Moreover, its dependency on the concentration of its ligand further provides tunable control of degradation rates.

Several protein domains with destabilizing properties and their paired small molecules have been identified and used to control protein expression, including FKBP/shield-1 system (Egeler et al., *J Biol. Chem.* 2011, 286(36): 32328-31336; the contents of which are incorporated herein by reference in their entirety), and ecDHFR and its ligand trimethoprim (TMP).

In some embodiments, the DDs of the present disclosure may be derived from some known sequences that have been approved to be capable of post-translational regulation of proteins.

In some embodiments, the DDs of the present disclosure may be developed from known proteins. Regions or portions or domains of wild type proteins may be utilized as SREs/DDs in whole or in part. They may be combined or rearranged to create new peptides, proteins, regions or domains of which any may be used as SREs/DDs or the starting point for the design of further SREs and/or DDs.

In some embodiments, the SRE may include at least one destabilizing domain (DD). The DD may be derived from a parent protein or from a mutant protein having one, two, three, or more amino acid mutations compared to the parent protein. In some embodiments, the parent protein may be selected from, but is not limited to, human protein FKBP (SEQ ID NO. 29); human DHFR (hDHFR) (SEQ ID NO. 26 and 27), *E. coli* DHFR (ecDHFR) (SEQ ID NO. 28), PDE5 (SEQ ID NO. 1-24), PPAR gamma (SEQ ID NO. 30), CA2 (SEQ ID NO. 31), NQO2 (SEQ ID NO. 32), DPPIV (SEQ ID NO. 33), and ER (SEQ ID NO. 34).

Some examples of the proteins that may be used to develop DDs and their ligands are listed in Table 1. Exemplary ligands for some of the proteins are also provided in Table 1.

TABLE 1

Proteins and their binding ligands

| DD Identifier | Protein | Protein SEQ ID NO. | Nucleic Acid SEQ ID NO. | Ligands |
|---|---|---|---|---|
| PDE5DD-187 | Human Phosphodiesterase 5 (hPDE5) (Uniprot ID: O76074) | 1 | 400 | Sildenafil; Vardenafil; Tadalafil |
| PDE5DD-188 | Human Phosphodiesterase 1A (hPDE1A) (Uniprot ID: P54750) | 2 | | Vinpocetine |
| PDE5DD-190 | Human Phosphodiesterase 1B (hPDE1B) (Uniprot ID: Q01064) | 3 | | |
| PDE5DD-192 | Human Phosphodiesterase 1C (hPDE1C) (Uniprot ID: Q14123) | 4 | | |
| PDE5DD-194 | Human Phosphodiesterase 2A (hPDE2A) (Uniprot ID: O00408) | 5 | | EHNA (erythro-9-(2- |

TABLE 1-continued

Proteins and their binding ligands

| DD Identifier | Protein | Protein SEQ ID NO. | Nucleic Acid SEQ ID NO. | Ligands |
|---|---|---|---|---|
| | | | | hydroxy-3-nonyl) adenine), Oxindole, PDP, BAY 60-7550 |
| PDE5DD-196 | Human Phosphodiesterase 3A (hPDE3A) (Uniprot ID: Q14432) | 6 | | Amrinone, Cilostazol, Milrinone, Enoximone, Pimobendan |
| PDE5DD-198 | Human Phosphodiesterase 3B (hPDE3B) (Uniprot ID: Q13370) | 7 | | |
| PDE5DD-200 | Human Phosphodiesterase 4A (hPDE4A) (Uniprot ID: P27815) | 8 | | AN2728, Apremilast, CC10004, Roflumilast, E6005, Cilomilast, Mesembrenone, Piclamilast, Rolipram, Atizoram, Arofylline, CC-1088, Catramilast, CGH-2466, Cipamfylline, Drotaverine, Filaminast, HT-0712, DNS-001, ICI-63197, Indimilast, Irsogladine, Lirimilast, Oglemilast |
| PDE5DD-202 | Human Phosphodiesterase 4B (hPDE4B) (Uniprot ID: Q07343) | 9 | | |
| PDE5DD-204 | Human Phosphodiesterase 4C (hPDE4C) (Uniprot ID: Q08493) | 10 | | |
| PDE5DD-206 | Human Phosphodiesterase 4D (hPDE4D) (Uniprot ID: Q08499) | 11 | | |
| PDE5DD-208 | Human Phosphodiesterase 6A (hPDE6A) (Uniprot ID: P16499) | 12 | | |
| PDE5DD-210 | Human Phosphodiesterase 6B (hPDE6B) (Uniprot ID: P35913) | 13 | | |
| PDE5DD-212 | Human Phosphodiesterase 6C (hPDE6C) (Uniprot ID: P51160) | 14 | | |
| PDE5DD-214 | Human Phosphodiesterase 7A (hPDE7A) (Uniprot ID: Q13946) | 15 | | BRL-50481, ASB16165 |
| PDE5DD-216 | Human Phosphodiesterase 7B (hPDE7B) (Uniprot ID: Q9NP56) | 16 | | |
| PDE5DD-218 | Human Phosphodiesterase 8A (hPDE8A) (Uniprot ID: O60658) | 17 | | PF-04957325 |
| PDE5DD-220 | Human Phosphodiesterase 8B (hPDE8B) (Uniprot ID: O65263) | 18 | | |
| PDE5DD-222 | Human Phosphodiesterase 9A (hPDE9A) (Uniprot ID: O76803) | 19 | | BAY73-6691, PF-04447943, WYQ-C28L |
| PDE5DD-224 | Human Phosphodiesterase 10A (hPDE10A) (Uniprot ID: Q9Y233) | 20 | | OMS 824, Papaverine, PF-2545920, GS-5759 |
| PDE5DD-226 | Human Phosphodiesterase 11A (hPDE11A) (Uniprot ID: Q9HCR9) | 21 | | |
| PDE5DD-229 | Human Phosphodiesterase 5 (hPDE5) Isoform 2 | 22 | 401 | |
| PDE5DD-232 | Human Phosphodiesterase 5 (hPDE5) Isoform 3 | 23 | 402-403 | |
| PDE5DD-234 | Human Phosphodiesterase 5 (hPDE5) Isoform X1 | 24 | 404 | |
| hDHFRDD-84 | Human Dihydrofolate reductase (hDHFR) Isoform 1 (Uniprot ID: P00374.2) | 25 | 407 | Methotrexate (MTX), Trimethoprim (TMP) |
| hDHFRDD-87 | Human Dihydrofolate reductase (hDHFR) Variant | 26 | | Methotrexate (MTX), Trimethoprim (TMP) |

TABLE 1-continued

Proteins and their binding ligands

| DD Identifier | Protein | Protein SEQ ID NO. | Nucleic Acid SEQ ID NO. | Ligands |
|---|---|---|---|---|
| hDHFRDD-88 | Dihydrofolate reductase 2 (hDHFR2) (DHFRL1) | 27 | 410 | Methotrexate (MTX), Trimethoprim (TMP) |
| ecDHFRDD-6 | E. coli Dihydrofolate reductase (ecDHFR) (Uniprot ID: POABQ4) | 28 | 405 | Methotrexate (MTX), Trimethoprim (TMP) |
| FKBPDD-8 | FK506 binding protein (FKBP) (Uniprot ID: P62942) | 29 | | Shield-1 |
| PPARGDD-1 | PPAR gamma (PPARg) (Uniprot ID: P37231) | 30 | | Posiglitazone; Pioglitazone |
| CA2DD-1 | Carbonic anhydrase II (CA2) (Uniprot ID: P00918) | 31 | | Celecoxib, Acetazolamide |
| NQO2DD-1 | NRH: Quinone oxidoreductase 2 (NQO2) (Uniprot ID: P16083) | 32 | | Imatinib, Melatonin |
| DPPIVDD-1 | Dipeptidyl peptidases (DPPIV) (Uniprot ID: P27487) | 33 | | Sitagliptin, Saxagliptin, Denagliptin |
| ERDD-4 | Estrogen Receptor (ER) (Uniprot ID: P03372.2) | 34 | | Bazedoxifene, Raloxifene 4-hydroxy-tamoxifen (4-OHT), fulvestrant, oremifene, lasofoxifene, clomifene, femarelle, ormeloxifene |

In some embodiments, the protein which may be used to develop DDs is listed in Table 1. In some embodiments, the sequence of a protein used to develop DDs may comprise all, part of, or a region thereof of a protein sequence in Table 1.

In one embodiment, the protein which may be used to develop DDs is hPDE5. As a non-limiting example, the hPDE5 protein sequence may comprise all, part of, or a region thereof of SEQ ID NO: 1. As a non-limiting example, the hPDE5 nucleic acid sequence may comprise all, part of, or a region thereof of SEQ ID NO: 400. The ligand for the DDs developed from hPDE5 may be, but is not limited to, Sildenafil, Vardenafil, and Tadalafil.

In one embodiment, the protein which may be used to develop DDs is hPDE5 isoform 2. As a non-limiting example, the hPDE5 isoform 2 protein sequence may comprise all, part of, or a region thereof of SEQ ID NO: 22. As a non-limiting example, the hPDE5 isoform 2 nucleic acid sequence may comprise all, part of, or a region thereof of SEQ ID NO: 401.

In one embodiment, the protein which may be used to develop DDs is hPDE5 isoform 3. As a non-limiting example, the hPDE5 isoform 3 protein sequence may comprise all, part of, or a region thereof of SEQ ID NO: 23. As a non-limiting example, the hPDE5 isoform 3 nucleic acid sequence may comprise all, part of, or a region thereof SEQ ID NO: 402. As a non-limiting example, the hPDE5 isoform 3 nucleic acid sequence may comprise all, part of, or a region thereof of SEQ ID NO: 403.

In one embodiment, the protein which may be used to develop DDs is hPDE5 isoform X1. As a non-limiting example, the hPDE5 isoform X1 protein sequence may comprise all, part of, or a region thereof of SEQ ID NO: 24. As a non-limiting example, the hPDE5 isoform X1 nucleic acid sequence may comprise all, part of, or a region thereof SEQ ID NO: 404.

Any region of the proteins in Table 1 may be used to develop DDs. Non-limiting examples of various regions which may be used as DDs or as a parent protein to derive additional DDs are shown in Table 2.

TABLE 2

Protein Regions

| DD Identifier | Protein and Protein Region | Protein SEQ ID NO. | Nucleic Acid SEQ ID NO. |
|---|---|---|---|
| PDE5DD-235 | Human Phosphodiesterase 5 (hPDE5) (Amino acid 535-860 of Uniprot ID: O76074) | 35 | 406 |
| PDE5DD-236 | Human Phosphodiesterase 5 (hPDE5) (Amino acid 535-830 of Uniprot ID: O76074) | 36 | |
| PDE5DD-237 | Human Phosphodiesterase 5 (hPDE5) (Amino acid 535-836 of Uniprot ID: O76074) | 37 | |

TABLE 2-continued

Protein Regions

| DD Identifier | Protein and Protein Region | Protein SEQ ID NO. | Nucleic Acid SEQ ID NO. |
|---|---|---|---|
| PDE5DD-238 | Human Phosphodiesterase 5 (hPDE5) (Amino acid 567-860 of Uniprot ID: O76074) | 38 | |
| PDE5DD-239 | Human Phosphodiesterase 5 (hPDE5) (Amino acid 590-836 of Uniprot ID: O76074) | 39 | |
| PDE5DD-240 | Human Phosphodiesterase 5 (hPDE5) (Amino acid 590-860 of Uniprot ID: O76074) | 40 | |
| PDE5DD-189 | Human Phosphodiesterase 1A (hPDE1A) (Amino acid 193-515 of Uniprot ID: P54750) (Catalytic Domain) | 41 | |
| PDE5DD-191 | Human Phosphodiesterase 1B (hPDE1B) (Amino acid 197-496 of Uniprot ID: Q01064) (Catalytic Domain) | 42 | |
| PDE5DD-193 | Human Phosphodiesterase 1C (hPDEIC) (Amino acid 202-521 of Uniprot ID: Q14123) (Catalytic Domain) | 43 | |
| PDE5DD-195 | Human Phosphodiesterase 2A (hPDE2A) (Amino acid 633-891 of Uniprot ID: Q14123) (Catalytic Domain) | 44 | |
| PDE5DD-197 | Human Phosphodiesterase 3A (hPDE3A) (Amino acid 728-1086 of Uniprot ID: Q14432) (Catalytic Domain) | 45 | |
| PDE5DD-199 | Human Phosphodiesterase 3B (hPDE3B) (Amino acid 713-1072 of Uniprot ID: Q13370) (Catalytic Domain) | 46 | |
| PDE5DD-201 | Human Phosphodiesterase 4A (hPDE4A) (Amino acid 330-723 of Uniprot ID: Q14432) (Catalytic Domain) | 47 | |
| PDE5DD-203 | Human Phosphodiesterase 4B (hPDE4B) (Amino acid 330-682 of Uniprot ID: Q07343) (Catalytic Domain) | 48 | |
| PDE5DD-205 | Human Phosphodiesterase 4C (hPDE4C) (Amino acid 312-677 of Uniprot ID: Q087493) (Catalytic Domain) | 49 | |
| PDE5DD-207 | Human Phosphodiesterase 4D (hPDE4D) (Amino acid 386-751 of Uniprot ID: Q08499) (Catalytic Domain) | 50 | |
| PDE5DD-209 | Human Phosphodiesterase 6A (hPDE6A) (Amino acid 483-819 of Uniprot ID: P16499) (Catalytic Domain) | 51 | |
| PDE5DD-211 | Human Phosphodiesterase 6B (hPDE6B) (Amino acid 476-817 of Uniprot ID: P35913) (Catalytic Domain) | 52 | |
| PDE5DD-213 | Human Phosphodiesterase 6C (hPDE6C) (Amino acid 483-822 of Uniprot ID: P51160) (Catalytic Domain) | 53 | |
| PDE5DD-215 | Human Phosphodiesterase 7A (hPDE7A) (Amino acid 187-451 of Uniprot ID: Q13946) (Catalytic Domain) | 54 | |
| PDE5DD-217 | Human Phosphodiesterase 7B (hPDE7B) (Amino acid 172-410 of Uniprot ID: Q9NP56) (Catalytic Domain) | 55 | |
| PDE5DD-219 | Human Phosphodiesterase 8A (hPDE8A) (Amino acid 531-813 of Uniprot ID: O60658) (Catalytic Domain) | 56 | |
| PDE5DD-221 | Human Phosphodiesterase 8B (hPDE8B) (Amino acid 590-868 of Uniprot ID: O65263) (Catalytic Domain) | 57 | |
| PDE5DD-223 | Human Phosphodiesterase 9A (hPDE9A) (Amino acid 288-550 of Uniprot ID: O76803) (Catalytic Domain) | 58 | |
| PDE5DD-225 | Human Phosphodiesterase 10A (hPDE10A) (Amino acid 458-760 of Uniprot ID: Q9Y233) (Catalytic Domain) | 59 | |
| PDE5DD-227 | Human Phosphodiesterase 11A (hPDE11A) (Amino acid 640-905 of Uniprot ID: Q9HCR9) (Catalytic Domain) | 60 | |
| hDHFRDD-85 | Human Dihydrofolate reductase (hDHFR) Isoform 2 (Amino acid 53-187 of Uniprot ID: P00374.2) | 61 | 408 |
| hDHFRDD-86 | Human Dihydrofolate reductase (hDHFR) Isoform 3 (Amino acid 1-123 of Uniprot ID: P00374.2) | 62 | 409 |
| FKBPDD-1 | FK506 binding protein (FKBP) (Amino acid 2-108 of Uniprot ID: P62942) | 63 | |
| PPARGDD-2 | PPAR gamma (PPARg) (Amino acid 317-505 of Uniprot ID: P37231) | 64 | |
| ERDD-5 | Estrogen Receptor (ER) (Amino acid 304-549 of Uniprot ID: P03372.2) | 65 | 411 |

In one embodiment, amino acid 535-860 of hPDE5 (region shown as SEQ ID NO: 35; encoded by nucleic acid SEQ ID NO: 406) may be used to develop DDs.

In one embodiment, amino acid 535-860 of hPDE5 (region shown as SEQ ID NO: 36) may be used to develop DDs.

In one embodiment, amino acid 535-836 of hPDE5 (region shown as SEQ ID NO: 37) may be used to develop DDs.

In one embodiment, amino acid 567-860 of hPDE5 (region shown as SEQ ID NO: 38) may be used to develop DDs In one embodiment, amino acid 590-836 of hPDE5 (region shown as SEQ ID NO: 39) may be used to develop DDs In one embodiment, amino acid 590-860 of hPDE5 (region shown as SEQ ID NO: 40) may be used to develop DDs.

In one embodiment, amino acid 193-515 of hPDE1A (region shown as SEQ ID NO: 41) may be used to develop DDs. As a non-limiting example, the catalytic domain region of hPDE1A may be used to develop DDs.

In one embodiment, amino acid 197-496 of hPDE1B (region shown as SEQ ID NO: 42) may be used to develop DDs. As a non-limiting example, the catalytic domain region of hPDE1B may be used to develop DDs.

In one embodiment, amino acid 202-521 of hPDE1C (region shown as SEQ ID NO: 43) may be used to develop DDs. As a non-limiting example, the catalytic domain region of hPDE1C may be used to develop DDs.

In one embodiment, amino acid 633-891 of hPDE2A (region shown as SEQ ID NO: 44) may be used to develop DDs. As a non-limiting example, the catalytic domain region of hPDE2A may be used to develop DDs.

In one embodiment, amino acid 728-1086 of hPDE3A (region shown as SEQ ID NO: 45) may be used to develop DDs. As a non-limiting example, the catalytic domain region of hPDE3A may be used to develop DDs.

In one embodiment, amino acid amino acid 713-1072 of hPDE3B (region shown as SEQ ID NO: 46) may be used to develop DDs. As a non-limiting example, the catalytic domain region of hPDE3B may be used to develop DDs.

In one embodiment, amino acid amino acid 330-723 of hPDE4A (region shown as SEQ ID NO: 47) may be used to develop DDs. As a non-limiting example, the catalytic domain region of hPDE4A may be used to develop DDs.

In one embodiment, amino acid 330-682 of hPDE4B (region shown as SEQ ID NO: 48) may be used to develop DDs. As a non-limiting example, the catalytic domain region of hPDE4B may be used to develop DDs.

In one embodiment, amino acid 312-677 of hPDE4C (region shown as SEQ ID NO: 49) may be used to develop DDs. As a non-limiting example, the catalytic domain region of hPDE4C may be used to develop DDs.

In one embodiment, amino acid 386-751 of hPDE4D (region shown as SEQ ID NO: 50) may be used to develop DDs. As a non-limiting example, the catalytic domain region of hPDE4D may be used to develop DDs.

In one embodiment, amino acid 483-819 of hPDE6A (region shown as SEQ ID NO: 51) may be used to develop DDs. As a non-limiting example, the catalytic domain region of hPDE6A may be used to develop DDs.

In one embodiment, amino acid 476-817 of hPDE6B (region shown as SEQ ID NO: 52) may be used to develop DDs. As a non-limiting example, the catalytic domain region of hPDE6B may be used to develop DDs.

In one embodiment, amino acid 483-822 of hPDE6C (region shown as SEQ ID NO: 53) may be used to develop DDs. As a non-limiting example, the catalytic domain region of hPDE6C may be used to develop DDs.

In one embodiment, amino acid 187-451 of hPDE7A (region shown as SEQ ID NO: 54) may be used to develop DDs. As a non-limiting example, the catalytic domain region of hPDE7A may be used to develop DDs.

In one embodiment, amino acid 172-410 of hPDE7B (region shown as SEQ ID NO: 55) may be used to develop DDs. As a non-limiting example, the catalytic domain region of hPDE7B may be used to develop DDs.

In one embodiment, amino acid 531-813 of hPDE8A (region shown as SEQ ID NO: 56) may be used to develop DDs. As a non-limiting example, the catalytic domain region of hPDE8A may be used to develop DDs.

In one embodiment, amino acid 590-868 of hPDE8B (region shown as SEQ ID NO: 57) may be used to develop DDs. As a non-limiting example, the catalytic domain region of hPDE8B may be used to develop DDs.

In one embodiment, amino acid 288-550 of hPDE9A (region shown as SEQ ID NO: 58) may be used to develop DDs. As a non-limiting example, the catalytic domain region of hPDE9A may be used to develop DDs.

In one embodiment, amino acid 458-760 of hPDE10A (region shown as SEQ ID NO: 59) may be used to develop DDs. As a non-limiting example, the catalytic domain region of hPDE10A may be used to develop DDs.

In one embodiment, amino acid 640-905 of hPDE11A (region shown as SEQ ID NO: 60) may be used to develop DDs. As a non-limiting example, the catalytic domain region of hPDE11A may be used to develop DDs.

Candidate destabilizing domain sequence identified from protein domains of parent proteins (as a template) may be mutated to generate libraries of mutants based on the template candidate domain sequence. Mutagenesis strategies used to generate DD libraries may include site-directed mutagenesis e.g. by using structure guided information; or random mutagenesis e.g. using error-prone PCR, or a combination of both. In some embodiments, destabilizing domains identified using random mutagenesis may be used to identify structural properties of the candidate DDs that may be required for destabilization, which may then be used to further generate libraries of mutations using site directed mutagenesis.

In some embodiments, DD mutant libraries may be screened for mutations with altered, preferably higher binding affinity to the ligand, as compared to the wild type protein. DD libraries may also be screened using two or more ligands and DD mutations that are stabilized by some ligands but not others may be preferentially selected. DD mutations that bind preferentially to the ligand compared to a naturally occurring protein may also be selected. Such methods may be used to optimize ligand selection and ligand binding affinity of the DD. Additionally, such approaches can be used to minimize deleterious effects caused by off-target ligand binding.

In one embodiment, the effector modules and/or SREs of the present disclosure may include at least one destabilizing domain (DD). The effector modules and/or SRE may include 1, 2, 3, 4, 5, 6, 7, 8, 9, 10 or more than 10 DDs. When there are more than one DDs, each of the DDs may be derived from the same parent protein (e.g., PDE5), from different parent proteins (e.g., PDE5 and hDHFR), may be a fusion of two different parent proteins, or may be artificial.

In one embodiment, the effector modules and/or SREs of the present disclosure may include 2 DDs. In one embodiment, the effector modules and/or SREs of the present disclosure may include 3 DDs. In one embodiment, the effector modules and/or SREs of the present disclosure may include 4 DDs. In one embodiment, the effector modules and/or SREs of the present disclosure may include 5 DDs. In one embodiment, the effector modules and/or SREs of the present disclosure may include 6 DDs. In one embodiment, the effector modules and/or SREs of the present disclosure may include 7 DDs. In one embodiment, the effector modules and/or SREs of the present disclosure may include 8 DDs. In one embodiment, the effector modules and/or SREs of the present disclosure may include 9 DDs. In one embodiment, the effector modules and/or SREs of the present disclosure may include 10 DDs. The DDs may be derived from any parent protein known in the art and/or described herein. In some embodiments the DDs are derived from the same parent protein (e.g., PDE5). In some embodiments the DDs are derived from different regions of the same parent protein (e.g., amino acid 535-860 and amino acid 590-836 of PDE5). In some embodiments, the DDs are derived from different parent proteins (e.g., PDE5 and hDHFR).

Human Dihydrofolate Reductase (hDHFR) Derived Destabilizing Domains (DDs)

In one embodiment, the SRE may include at least one destabilizing domain (DD) derived from a human dihydrofolate reductase (hDHFR) protein such as, but not limited to, human dihydrofolate reductase 1 (hDHFR1), human dihydrofolate reductase 2 (hDHFR2), or a fragment or variant thereof. As a non-limiting example, the SRE comprises at least one DD derived from hDHFR1. As a non-limiting example, the SRE comprises at least one DD derived from hDHFR2.

In one embodiment, the DD may be derived from a hDHFR protein and include at least one mutation.

In one embodiment, the DD may be derived from a hDHFR protein and include more than one mutation. In some embodiments, DDs derived from hDHFR may comprise amino acids 2-187 of the parent hDHFR sequence. This is referred to herein as an M1del mutation.

In one embodiment, the stimulus is a small molecule that binds to a SRE to post-translationally regulate protein levels. In one aspect, DHFR ligands: trimethoprim (TMP) and methotrexate (MTX) are used to stabilize hDHFR mutants.

E. coli Dihydrofolate Reductase (ecDHFR) Derived Destabilizing Domains (DDs)

In one embodiment, the SRE may include at least one destabilizing domain (DD) derived from an *E. Coli* dihydrofolate reductase (ecDHFR) protein or a fragment or variant thereof.

In one embodiment, the DD may be derived from an ecDHFR protein and include at least one mutation.

In one embodiment, the DD may be derived from an ecDHFR protein and include more than one mutation.

In some embodiments, DDs derived from ecDHFR may comprise amino acids 2-159 of the parent ecDHFR sequence. This may be referred to herein as an M1del mutation.

In one embodiment, the stimulus is a small molecule that binds to a SRE to post-translationally regulate protein levels. In one aspect, ecDHFR ligands: trimethoprim (TMP) and methotrexate (MTX) are used to stabilize ecDHFR mutants.

FK506 Binding Protein (FKBP) Derived Destabilizing Domains (DDs)

In one embodiment, the SRE may include at least one destabilizing domain (DD) derived from a FK506 binding protein (FKBP) protein or a fragment or variant thereof.

In one embodiment, the DD may be derived from a FKBP protein and include at least one mutation.

In one embodiment, the DD may be derived from a FKBP protein and include more than one mutation.

In some embodiments, DDs derived from FKBP may comprise amino acids 2-108 of the parent FKBP sequence. This is referred to herein as an M1del mutation.

In one embodiment, the stimulus is a small molecule that binds to a SRE to post-translationally regulate protein levels. In one aspect, FKBP ligand Shield-1 is used to stabilize FKBP mutants.

Human Phosphodiesterase (hPDE) Derived Destabilizing Domains (DDs)

In one embodiment, the SRE may include at least one destabilizing domain (DD) derived from a human phosphodiesterase (hPDE) protein such as, but not limited to, human phosphodiesterase 1A (hPDE1A), human phosphodiesterase 1B (hPDE1B), human phosphodiesterase 1C (hPDE1C), human phosphodiesterase 1D (hPDE1D), human phosphodiesterase 2A (hPDE2A), human phosphodiesterase 3A (hPDE3A), human phosphodiesterase 3B (hPDE3B), human phosphodiesterase 4A (hPDE4A), human phosphodiesterase 4B (hPDE4B), human phosphodiesterase 4C (hPDE4C), human phosphodiesterase 4D (hPDE4D), human phosphodiesterase 6A (hPDE6A), human phosphodiesterase 6B (hPDE6B), human phosphodiesterase 6C (hPDE6C), human phosphodiesterase 7A (hPDE7A), human phosphodiesterase 7B (hPDE7B), human phosphodiesterase 8A (hPDE8A), human phosphodiesterase 8B (hPDE8B), human phosphodiesterase 9A (hPDE9A), human phosphodiesterase 10A (hPDE10A), and human phosphodiesterase 11A (hPDE11A), or a fragment or variant thereof. As a non-limiting example, the SRE comprises at least one DD derived from hPDE1A. As a non-limiting example, the SRE comprises at least one DD derived from hPDE1B. As a non-limiting example, the SRE comprises at least one DD derived from hPDE1C. As a non-limiting example, the SRE comprises at least one DD derived from hPDE1D. As a non-limiting example, the SRE comprises at least one DD derived from hPDE2A. As a non-limiting example, the SRE comprises at least one DD derived from hPDE3A. As a non-limiting example, the SRE comprises at least one DD derived from h hPDE3B. As a non-limiting example, the SRE comprises at least one DD derived from hPDE4A. As a non-limiting example, the SRE comprises at least one DD derived from hPDE4B. As a non-limiting example, the SRE comprises at least one DD derived from hPDE4C. As a non-limiting example, the SRE comprises at least one DD derived from hPDE4D. As a non-limiting example, the SRE comprises at least one DD derived from hPDE6A. As a non-limiting example, the SRE comprises at least one DD derived from hPDE6B. As a non-limiting example, the SRE comprises at least one DD derived from hPDE6C. As a non-limiting example, the SRE comprises at least one DD derived from hPDE7A. As a non-limiting example, the SRE comprises at least one DD derived from hPDE7B. As a non-limiting example, the SRE comprises at least one DD derived from hPDE8A. As a non-limiting example, the SRE comprises at least one DD derived from hPDE8B. As a non-limiting example, the SRE comprises at least one DD derived from hPDE9A. As a non-limiting example, the SRE comprises at least one DD derived from hPDE10A. As a non-limiting example, the SRE comprises at least one DD derived from hPDE11A.

In one embodiment, the SRE comprises a region of the hPDE protein. The region of the hPDE protein may be 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, or more than 450 amino acids in length. The region of the parent protein may be 5-50, 25-75, 50-100, 75-125, 100-150, 125-175, 150-200, 175-225, 200-250, 225-275, 250-300, 275-325, 300-350, 325-375, 350-400, 375-425, or 400-450 amino acids in length.

In one embodiment, the DD may be derived from a PDE protein and include at least one mutation.

A non-limiting listing of PDE5 derived destabilizing domains (amino acid and nucleic acid sequences) are listed in Table 3. The position of the mutated amino acid listed in Table 3 is relative to PDE5 (Uniprot ID: 076074) of SEQ ID NO. 1. In one embodiment, the DD is derived from human PDE5 having an amino acid sequence: MERAGPSFGQ QRQQQQPQQQ KQQQRDQDSV EAWLDDHWDF TFSYFVRKATREMVNAWFAE RVHTIPVCKE GIR-GHTESCS CPLQQSPRAD NSAPGTPTRK ISASEFDRPL RPIVVKDSEG TVSFLSDSEK KEQMPLTPPR FDHDE-GDQCSRLLELVKDIS SHLDVTALCH KIFLHIHGLI SADRYSLFLV CEDSSNDKFLISRLFDVAEG STLEEVSNNC IRLEWNKGIV GHVAALGEPL NIK-DAYEDPRFNAEVDQITG YKTQSILCMP IKNHREEVVG VAQAINKKSG NGGTFTEKDEKD-FAAYLAFC GIVLHNAQLY ETSLLENKRN QVLLD-LASLI FEEQQSLEVILKKIAATIIS FMQVQKCTIF IVD-EDCSDSF SSVFHMECEE LEKSSDTLREHDANKINYM YAQYVKNTME PLNIPDVSKD KRFPWTTENT GNVNQQCIRSLLCT-PIKNGK KNKVIGVCQL VNKMEENTGK VKPFNRNDEQ FLEAFVIFCGLGIQNTQMYE AVERA-MAKQM VTLEVLSYHA SAAEEETREL QSLAAAVVP-SAQTLKITDFS FSDFELSDLE TALCTIRMFT DLNLVQNFQM KHEVLCRWILSVKKNYRKNV AYHNWRHAFN TAQCMFAALK AGKIQNKLTD LEILALLIAALSHDLDHRGV NNSYIQRSEH PLAQLYCHSI MEHHHFDQCL MILNSPGNQILSGL-SIEEYK TTLKIIKQAI LATDLALYIK RRGEFFELIR KNQFNLEDPH QKELFLAMLM TACDLSAITK PWPIQQRIAE LVATEFFDQG DRERKELNIE PTDLMN-REKK NKIPSMQVGF IDAICLQLYE ALTHVSEDCF PLLDGCRKNR QKWQALAEQQ EKMLINGESG QAKRN (SEQ ID NO. 1).

In one embodiment, the DD may be derived from a PDE5 protein and include at least one mutation. Non-limiting examples of mutations include E535D, E536G, Q541R, S542L, V548M, P549S, S550F, L554R, K555R, I556S, F559L, S560G, F561L, S562G, F564L, F564S, F564I, L569M, T571S, T571I, L573M, C574Y, V585A, V585M, N587S, Q586L, Q586P, Q589E, K591E, H592R, V594I, I599V, K604R, K604E, N605D, N605Y, R607W, R607Q, K608E, N609H, N609Y, A611T, Y612F, Y612W, Y612A, H613L, H613R, W615R, H617L, N620S, M625I, K630R, K633E, N636S, I648V, H653A, D656L, R658H, G659A, N661S, N662Y, S663Y, S663P, Q666H, L675P, Y676D, Y676N, C677R, H678R, I680S, E682A, D687A, H685L, M691I, L693P, I700F, I706N, E708V, Y709H, K710N, T711A, T712S, T712M, I715K, A722V, T723S, T723R, D724Y, D724A, D724N, D724G, L727P, Y728L, K730E, R732L, R732G, R732A, R732V, R732I, R732P, R732F, R732W, R732Y, R732H, R732S, R732T, R732D, R732E, R732Q, R732N, R732M, R732C, R732K, F735L, F736A, F736G, F736L, F736M, F736R, F736W, F736K, F736Q, F736E, F736S, F736P, F736V, F736C, F736Y, F736H, F736I, F736N, F736D, F736T, L738H, N742S, Q743L, F744L, L746S, F755L, F755Y, M758I, M760I, A762T, A762S, D764N, D764G, D764V, D764A, S766F, A767E, I768N, K770Q, W772C, A779T, L781P, T784I, F787V, F787A, K795E, E795R, K795N, E796G, E796D, L797F, I799L, I799T, T802P, D803N, L804P, E808G, S815C, M816A, M816T, F820I, I821A, A823T, I824T, Y829A, T833S, C839S, F840S, R847G, R847T, K848N, K852E, W853F, E858V, and Q859R.

In one embodiment, the DD may be derived from a PDE5 protein and include more than one mutation. Any of the mutations listed herein may be included in the DD. Non-limiting examples of double mutations include Y612A, R732L; Y612F, R732L; Y612W, R732L; Y709H, F787V; Y728L, D764N; L569M, T833S; D724A, R732L; D724G, D764G; D724K, K848N; E682A, R732L; F736A, D764N; G659A, T784I; H617L, A722V; H653A, R732L; I556S, E796D; I700F, E796G; K770Q, K848N; L573M, F735L; N605Y, I715K; N609Y, I799L; R732L, D764A; R732L, D764N; R732L, F736A; S550F, L554R; V548M, D803N; V548M, F820I. A non-limiting example of triple mutations include A722V, F755L, M760I; F561L, G659A, T784I; H613L, D724Y, F755Y; L554R, Q589E, A823T; L554R, Q589E, M691I; S542L, E708V, W772C; S562G, L727P, R847T; T571S, V585M, T723S; T712M, M758I, Q859R. A non-limiting example of four mutations include L554R, Q586P, K710N, K730E; Q586L, S663Y, A762T, E808G; T571I, K604R, I706N, E795R; W615R, T723R, A762T, E808G. A non-limiting example of five mutations include F564I, N662Y, H685L, L693P, F736I; P549S, F564I, R658H, A779T, R847G.

In some embodiments, DDs derived from PDE5 may comprise amino acids 2-875 of the parent PDE5 sequence. This is referred to herein as an M1del mutation.

In some embodiments, DDs are derived from a region of the PDE5 protein. As a non-limiting example, the region is amino acid 535-860 of hPDE5 (SEQ ID NO. 35). As a non-limiting example, the region is amino acid 535-830 of hPDE5 (SEQ ID NO. 36). As a non-limiting example, the region is amino acid 535-836 of hPDE5 (SEQ ID NO. 37). As a non-limiting example, the region is amino acid 567-860 of hPDE5 (SEQ ID NO. 38). As a non-limiting example, the region is amino acid 590-836 of hPDE5 (SEQ ID NO. 39). As a non-limiting example, the region is amino acid 590-860 of hPDE5 (SEQ ID NO. 40).

In one embodiment, the stimulus is a small molecule that binds to a SRE to post-translationally regulate protein levels. In one aspect, PDE5 ligands Sildenafil, Vardenafil, or Tadalafil are used to stabilize PDE5 mutants.

In Table 3, "del" means that the mutation is the deletion of the amino acid at that position relative to the wild type sequence.

TABLE 3

| PDE5 Derived Destabilizing Domains (DDs) | | | |
|---|---|---|---|
| DD Identifier | PDE5 region and Mutations | Amino acid SEQ ID | Nucleic Acid SEQ ID |
| PDE5DD-1 | 535-860 of WT, W853F | 66 | 67 |
| PDE5DD-2 | 535-860 of WT, I821A | 68 | 69 |
| PDE5DD-3 | 535-860 of WT, Y829A | 70 | 71 |
| PDE5DD-4 | 535-860 of WT, F787V | 72 | 73 |
| PDE5DD-5 | 535-860 of WT, F736A | 74 | 75-77 |
| PDE5DD-6 | 535-860 of WT, Y728L | 78 | 79 |
| PDE5DD-7 | 535-860 of WT, R732L | 80 | 81-84 |
| PDE5DD-8 | 535-860 of WT, M625I | 85 | 86 |

TABLE 3-continued

PDE5 Derived Destabilizing Domains (DDs)

| DD Identifier | PDE5 region and Mutations | Amino acid SEQ ID | Nucleic Acid SEQ ID |
|---|---|---|---|
| PDE5DD-9 | 535-860 of WT, D656L | 87 | 88 |
| PDE5DD-10 | 535-860 of WT, E535D | 89 | |
| PDE5DD-11 | 535-860 of WT, E536G | 90 | |
| PDE5DD-12 | 535-860 of WT, Q541R | 91 | |
| PDE5DD-13 | 535-860 of WT, K555R | 92 | |
| PDE5DD-14 | 535-860 of WT, F559L | 93 | |
| PDE5DD-15 | 535-860 of WT, F561L | 94 | |
| PDE5DD-16 | 535-860 of WT, F564L | 95 | |
| PDE5DD-17 | 535-860 of WT, F564S | 96 | |
| PDE5DD-18 | 535-860 of WT, K591E | 97 | |
| PDE5DD-19 | 535-860 of WT, N587S | 98 | |
| PDE5DD-20 | 535-860 of WT, K604E | 99 | |
| PDE5DD-21 | 535-860 of WT, K608E | 100 | |
| PDE5DD-22 | 535-860 of WT, N609H | 101 | |
| PDE5DD-23 | 535-860 of WT, K630R | 102 | |
| PDE5DD-24 | 535-860 of WT, K633E | 103 | |
| PDE5DD-25 | 535-860 of WT, N636S | 104 | |
| PDE5DD-26 | 535-860 of WT, N661S | 105 | 106 |
| PDE5DD-27 | 535-860 of WT, Y676D | 107 | |
| PDE5DD-28 | 535-860 of WT, Y676N | 108 | |
| PDE5DD-29 | 535-860 of WT, C677R | 109 | |
| PDE5DD-30 | 535-860 of WT, H678R | 110 | |
| PDE5DD-31 | 535-860 of WT, D687A | 111 | |
| PDE5DD-32 | 535-860 of WT, T712S | 112 | |
| PDE5DD-33 | 535-860 of WT, D724N | 113 | |
| PDE5DD-34 | 535-860 of WT, D724G | 114 | |
| PDE5DD-35 | 535-860 of WT, L738H | 115 | |
| PDE5DD-36 | 535-860 of WT, N742S | 116 | |
| PDE5DD-37 | 535-860 of WT, A762S | 117 | |
| PDE5DD-38 | 535-860 of WT, D764N | 118 | |
| PDE5DD-39 | 535-860 of WT, D764G | 119 | |
| PDE5DD-40 | 535-860 of WT, D764V | 120 | |
| PDE5DD-41 | 535-860 of WT, S766F | 121 | |
| PDE5DD-42 | 535-860 of WT, K795E | 122 | |
| PDE5DD-43 | 535-860 of WT, L797F | 123 | |
| PDE5DD-44 | 535-860 of WT, I799T | 124 | |
| PDE5DD-45 | 535-860 of WT, T802P | 125 | |
| PDE5DD-46 | 535-860 of WT, S815C | 126 | |
| PDE5DD-47 | 535-860 of WT, M816A | 127 | |
| PDE5DD-48 | 535-860 of WT, I824T | 128 | |
| PDE5DD-49 | 535-860 of WT, C839S | 129 | |
| PDE5DD-50 | 535-860 of WT, K852E | 130 | |
| PDE5DD-51 | 535-860 of WT, S560G | 131 | |
| PDE5DD-52 | 535-860 of WT, V585A | 132 | |
| PDE5DD-53 | 535-860 of WT, I599V | 133 | |
| PDE5DD-54 | 535-860 of WT, I648V | 134 | |
| PDE5DD-55 | 535-860 of WT, S663P | 135 | |
| PDE5DD-56 | 535-860 of WT, L675P | 136 | |
| PDE5DD-57 | 535-860 of WT, T711A | 137 | |
| PDE5DD-58 | 535-860 of WT, F744L | 138 | |
| PDE5DD-59 | 535-860 of WT, L746S | 139 | |
| PDE5DD-60 | 535-860 of WT, F755L | 140 | |
| PDE5DD-61 | 535-860 of WT, L804P | 141 | |
| PDE5DD-62 | 535-860 of WT, M816T | 142 | |
| PDE5DD-63 | 535-860 of WT, F840S | 143 | |
| PDE5DD-64 | 535-860 of WT, R732G | 144 | 145-146 |
| PDE5DD-65 | 535-860 of WT, R732A | 147 | 148-149 |
| PDE5DD-66 | 535-860 of WT, R732V | 150 | 151-152 |
| PDE5DD-67 | 535-860 of WT, R732I | 153 | 154, 471 |
| PDE5DD-68 | 535-860 of WT, R732P | 155 | 156-157 |
| PDE5DD-69 | 535-860 of WT, R732F | 158 | 159 |
| PDE5DD-70 | 535-860 of WT, R732W | 160 | 161 |
| PDE5DD-71 | 535-860 of WT, R732Y | 162 | 163-164 |
| PDE5DD-72 | 535-860 of WT, R732H | 165 | 166-167 |
| PDE5DD-73 | 535-860 of WT, R732S | 168 | 169-170 |
| PDE5DD-74 | 535-860 of WT, R732T | 171 | 172, 473 |
| PDE5DD-75 | 535-860 of WT, R732D | 173 | 174-175 |
| PDE5DD-76 | 535-860 of WT, R732E | 176 | 177-178 |
| PDE5DD-77 | 535-860 of WT, R732Q | 179 | 180-181 |
| PDE5DD-78 | 535-860 of WT, R732N | 182 | 183, 472 |
| PDE5DD-79 | 535-860 of WT, R732M | 184 | 185 |
| PDE5DD-80 | 535-860 of WT, R732C | 186 | 187, 485 |
| PDE5DD-81 | 535-860 of WT, R732K | 188 | 189 |
| PDE5DD-82 | 535-860 of WT, H653A | 190 | 191 |
| PDE5DD-83 | 535-860 of WT, D764A | 192 | 193 |
| PDE5DD-84 | 535-860 of WT, R658H | 194 | 195 |
| PDE5DD-85 | 535-860 of WT, Q666H | 196 | 197 |
| PDE5DD-86 | 535-860 of WT, L781P | 198 | 199 |
| PDE5DD-87 | 535-860 of WT, A767E | 200 | 201 |
| PDE5DD-88 | 535-860 of WT, Q743L | 202 | 203 |
| PDE5DD-89 | 535-860 of WT, V594I | 204 | 205 |
| PDE5DD-90 | 535-860 of WT, H592R | 206 | 207 |
| PDE5DD-91 | 535-860 of WT, E858V | 208 | 209 |
| PDE5DD-92 | 535-860 of WT, T784I | 210 | 211 |
| PDE5DD-93 | 535-860 of WT, F736G | 212 | 213 |
| PDE5DD-94 | 535-860 of WT, F736L | 214 | 215 |
| PDE5DD-95 | 535-860 of WT, F736M | 216 | 217 |
| PDE5DD-96 | 535-860 of WT, F736R | 218 | 219 |
| PDE5DD-97 | 535-860 of WT, F736W | 220 | 221 |
| PDE5DD-98 | 535-860 of WT, F736K | 222 | 223 |
| PDE5DD-99 | 535-860 of WT, F736Q | 224 | 225 |
| PDE5DD-100 | 535-860 of WT, F736E | 226 | 227 |
| PDE5DD-101 | 535-860 of WT, F736S | 228 | 229 |
| PDE5DD-102 | 535-860 of WT, F736P | 230 | 231 |
| PDE5DD-103 | 535-860 of WT, F736V | 232 | 233 |
| PDE5DD-104 | 535-860 of WT, F736I | 234 | 235 |
| PDE5DD-105 | 535-860 of WT, F736C | 236 | 237 |
| PDE5DD-106 | 535-860 of WT, F736Y | 238 | 239 |
| PDE5DD-107 | 535-860 of WT, F736H | 240 | 241 |
| PDE5DD-108 | 535-860 of WT, F736N | 242 | 243 |
| PDE5DD-109 | 535-860 of WT, F736D | 244 | 245 |
| PDE5DD-110 | 535-860 of WT, F736T | 246 | 247 |
| PDE5DD-111 | 535-860 of WT, I680S | 248 | 249 |
| PDE5DD-112 | 535-860 of WT, A611T | 250 | 251 |
| PDE5DD-113 | 535-860 of WT, I768N | 252 | 253 |
| PDE5DD-114 | 535-860 of WT, R607W | 254 | 255 |
| PDE5DD-115 | 535-860 of WT, N620S | 256 | 257 |
| PDE5DD-116 | 535-860 of WT, C574Y | 258 | 259 |
| PDE5DD-117 | 535-860 of WT, H613R | 260 | 261 |
| PDE5DD-118 | 535-860 of WT, K795N | 262 | 263 |
| PDE5DD-119 | 535-860 of WT, N605D | 264 | 265 |
| PDE5DD-120 | 535-860 of WT, I799L | 266 | 267 |
| PDE5DD-121 | 535-860 of WT, R607Q | 268 | 269 |
| PDE5DD-122 | 535-860 of WT, E682A | 270 | 271 |
| PDE5DD-123 | 535-860 of WT, D724A | 272 | 273 |
| PDE5DD-124 | 590-860 of WT, R732L | 274 | 275 |
| PDE5DD-125 | 567-860 of WT, R732L | 276 | 277 |
| PDE5DD-126 | 590-836 of WT, R732G | 278 | 279 |
| PDE5DD-127 | 590-836 of WT, R732A | 280 | 281 |
| PDE5DD-128 | 590-836 of WT, R732V | 282 | 283 |
| PDE5DD-129 | 590-836 of WT, R732I | 284 | 285 |
| PDE5DD-130 | 590-836 of WT, R732P | 286 | 287 |
| PDE5DD-131 | 590-836 of WT, R732F | 288 | 289 |
| PDE5DD-132 | 590-836 of WT, R732W | 290 | 291 |
| PDE5DD-133 | 590-836 of WT, R732Y | 292 | 293 |
| PDE5DD-134 | 590-836 of WT, R732H | 294 | 295 |
| PDE5DD-135 | 590-836 of WT, R732S | 296 | 297 |
| PDE5DD-136 | 590-836 of WT, R732T | 298 | 299 |
| PDE5DD-137 | 590-836 of WT, R732D | 300 | 301 |
| PDE5DD-138 | 590-836 of WT, R732E | 302 | 303 |
| PDE5DD-139 | 590-836 of WT, R732Q | 304 | 305 |
| PDE5DD-140 | 590-836 of WT, R732N | 306 | 307 |
| PDE5DD-141 | 590-836 of WT, R732M | 308 | 309 |
| PDE5DD-142 | 590-836 of WT, R732C | 310 | 311 |
| PDE5DD-143 | 590-836 of WT, R732K | 312 | 313 |
| PDE5DD-144 | 590-836 of WT, R732L | 314 | 315 |
| PDE5DD-145 | 535-836 of WT, R732L | 316 | 317 |
| PDE5DD-146 | 535-860 of WT, Y612F, R732L | 318 | 319 |
| PDE5DD-147 | 535-860 of WT, Y612W, R732L | 320 | 321 |
| PDE5DD-148 | 535-860 of WT, Y612A, R732L | 322 | 323 |
| PDE5DD-149 | 535-860 of WT, F736A, D764N | 324 | 325 |
| PDE5DD-150 | 535-860 of WT, R732L, D764N | 326 | 327 |
| PDE5DD-151 | 535-860 of WT, R732L, F736A | 328 | 329, 470 |
| PDE5DD-152 | 535-860 of WT, H653A, R732L | 330 | 331 |
| PDE5DD-153 | 535-860 of WT, R732L, D764A | 332 | 333 |
| PDE5DD-154 | 535-860 of WT, L573M, F735L | 334 | 335 |
| PDE5DD-155 | 535-860 of WT, Y709H, F787V | 336 | 337 |
| PDE5DD-156 | 535-860 of WT, N605Y, I715K | 338 | 339 |

TABLE 3-continued

PDE5 Derived Destabilizing Domains (DDs)

| DD Identifier | PDE5 region and Mutations | Amino acid SEQ ID | Nucleic Acid SEQ ID |
|---|---|---|---|
| PDE5DD-157 | 535-860 of WT, I700F, E796G | 340 | 341 |
| PDE5DD-158 | 535-860 of WT, D724G, K848N | 342 | 343 |
| PDE5DD-159 | 535-860 of WT, I556S, E796D | 344 | 345 |
| PDE5DD-160 | 535-860 of WT, L569M, T833S | 346 | 347 |
| PDE5DD-161 | 535-860 of WT, V548M, D803N | 348 | 349 |
| PDE5DD-162 | 535-860 of WT, G659A, T784I | 350 | 351 |
| PDE5DD-163 | 535-860 of WT, H617L, A722V | 352 | 353 |
| PDE5DD-164 | 535-860 of WT, N609Y, I799L | 354 | 355 |
| PDE5DD-165 | 535-860 of WT, K770Q, K848N | 356 | 357 |
| PDE5DD-166 | 535-860 of WT, V548M, F820I | 358 | 359 |
| PDE5DD-167 | 535-860 of WT, S550F, L554R | 360 | 361 |
| PDE5DD-168 | 535-860 of WT, D724G, D764G | 362 | 363 |
| PDE5DD-169 | 535-860 of WT, Y728L, D764N | 364 | 365 |
| PDE5DD-170 | 535-860 of WT, E682A, R732L | 366 | 367 |
| PDE5DD-171 | 535-860 of WT, D724A, R732L | 368 | 369 |
| PDE5DD-172 | 535-860 of WT, S562G, L727P, R847T | 370 | 371 |
| PDE5DD-173 | 535-860 of WT, T571S, V585M, T723S | 372 | 373 |
| PDE5DD-174 | 535-860 of WT, A722V, F755L, M760I | 374 | 375 |
| PDE5DD-175 | 535-860 of WT, S542L, E708V, W772C | 376 | 377 |
| PDE5DD-176 | 535-860 of WT, T712M, M758I, Q859R | 378 | 379 |
| PDE5DD-177 | 535-860 of WT, H613L, D724Y, F755Y | 380 | 381 |
| PDE5DD-178 | 535-860 of WT, L554R, Q589E, M691I | 382 | 383 |
| PDE5DD-179 | 535-860 of WT, L554R, Q589E, A823T | 384 | 385 |
| PDE5DD-180 | 535-860 of WT, F561L, G659A, T784I | 386 | 387 |
| PDE5DD-181 | 535-860 of WT, W615R, T723R, A762T, E808G | 388 | 389 |
| PDE5DD-182 | 535-860 of WT, L554R, Q586P, K710N, K730E | 390 | 391 |
| PDE5DD-183 | 535-860 of WT, Q586L, S663Y, A762T, E808G | 392 | 393 |
| PDE5DD-184 | 535-860 of WT, T571I, K604R, I706N, E795R | 394 | 395 |
| PDE5DD-185 | 535-860 of WT, F564I, N662Y, H685L, L693P, F736I | 396 | 397 |
| PDE5DD-186 | 535-860 of WT, P549S, F564I, R658H, A779T, R847G | 398 | 399 |
| PDE5DD-187 | 535-860 of WT, R732D, F736S | 490 | 491 |
| PDE5DD-188 | 535-860 of WT, R732E, F736D | 492 | 493 |
| PDE5DD-189 | 535-860 of WT, R732V, F736G | 494 | 495 |
| PDE5DD-190 | 535-860 of WT, R732W, F736G | 496 | 497 |
| PDE5DD-191 | 535-860 of WT, R732W, F736V | 498 | 499 |
| PDE5DD-192 | 535-860 of WT, R732L, F736W | 500 | 501 |
| PDE5DD-193 | 535-860 of WT, R732P, F736Q | 502 | 503 |
| PDE5DD-194 | 535-860 of WT, R732A, F736A | 504 | 505 |
| PDE5DD-195 | 535-860 of WT, R732S, F736G | 506 | 507 |
| PDE5DD-196 | 535-860 of WT, R732T, F736P | 508 | 509 |
| PDE5DD-197 | 535-860 of WT, R732M, F736H | 510 | 511 |
| PDE5DD-198 | 535-860 of WT, R732Y, F736M | 512 | 513 |
| PDE5DD-199 | 535-860 of WT, R732P, F736D | 514 | 515 |
| PDE5DD-200 | 535-860 of WT, R732P, F736G | 516 | 517 |
| PDE5DD-201 | 535-860 of WT, R732W, F736L | 518 | 519 |
| PDE5DD-202 | 535-860 of WT, R732L, F736S | 520 | 521 |
| PDE5DD-203 | 535-860 of WT, R732D, F736T | 522 | 523 |
| PDE5DD-204 | 535-860 of WT, R732L, F736V | 524 | 525 |
| PDE5DD-205 | 535-860 of WT, R732G, F736V | 526 | 527 |
| PDE5DD-206 | 535-860 of WT, R732W, F736A | 528 | 529 |
| PDE5DD-207 | 535-860 of WT, C574N | 530 | 531 |
| PDE5DD-208 | 535-860 of WT, E536K, I739W | 532 | 533 |
| PDE5DD-209 | 535-860 of WT, H678F, S702F | 534 | 535 |
| PDE5DD-210 | 535-860 of WT, E669G, I700T | 536 | 537 |
| PDE5DD-211 | 535-860 of WT, G632S, I648T | 538 | 539 |
| PDE5DD-212 | 535-774 of WT, L646S | 540 | 541 |
| PDE5DD-213 | 535-860 of WT, A762V | 542 | 543 |
| PDE5DD-214 | 535-860 of WT, D640N | 544 | 545 |
| PDE5DD-215 | 535-860 of WT, N636S | 546 | 547 |
| PDE5DD-216 | 535-860 of WT, Q623R, D654G, K741N | 548 | 549 |
| PDE5DD-217 | 535-860 of WT, A673T, L756V, C846Y | 550 | 551 |
| PDE5DD-218 | 535-860 of WT, V660A, L781F, R794G, C825R, E858G | 552 | 553 |
| PDE5DD-219 | 535-860 of WT, E642G, G697D, I813T | 554 | 555 |
| PDE5DD-220 | 535-860 of WT, M758T | 556 | 557 |
| PDE5DD-221 | 535-860 of WT, K752E | 558 | 559 |
| PDE5DD-222 | 535-860 of WT, C677Y, H685R, A722V | 560 | 561 |
| PDE5DD-223 | 535-860 of WT, T639S, M816R | 562 | 563 |
| PDE5DD-224 | 535-860 of WT, T537A, D558G, I706F, F744L, D764N | 564 | 565 |
| PDE5DD-225 | 535-860 of WT, Q586R, D724G | 566 | 567 |
| PDE5DD-226 | 535-860 of WT, F686S | 568 | 569 |
| PDE5DD-227 | 535-860 of WT, E539G, L738I | 570 | 571 |
| PDE5DD-228 | 535-860 of WT, Q635R, E753K, I813T | 572 | 573 |
| PDE5DD-229 | 535-860 of WT, L672P, S836L | 574 | 575 |
| PDE5DD-230 | 535-860 of WT, M691T, D764N | 576 | 577 |
| PDE5DD-231 | 535-860 of WT, R807G | 578 | 579 |
| PDE5DD-232 | 535-860 of WT, R577Q, C596R, V660A, I715V, E785K, L856P | 580 | 581 |
| PDE5DD-233 | 535-860 of WT, I720V, F820S | 582 | 583 |
| PDE5DD-234 | 535-860 of WT, S695G, E707K, I739M, C763R | 584 | 585 |
| PDE5DD-235 | 535-860 of WT, Y709H, K812R, L832P | 586 | 587 |
| PDE5DD-236 | 535-860 of WT, N583S, K752E, C846S | 588 | 589 |
| PDE5DD-237 | 535-860 of WT, E682G, D748N | 590 | 591 |
| PDE5DD-238 | 535-860 of WT, K591R, I643T, L856P | 592 | 593 |
| PDE5DD-239 | 535-860 of WT, F619S, V818A, Y829C | 594 | 595 |
| PDE5DD-240 | 535-860 of WT, V548E, Q589L, K633I, M681T, S702I, K752E, L781P, A857T | 596 | 597 |
| PDE5DD-241 | 535-860 of WT, S652G, Q688R | 598 | 599 |
| PDE5DD-242 | 535-860 of WT, E565G | 600 | 601 |
| PDE5DD-243 | 535-860 of WT, I774V | 602 | 603 |
| PDE5DD-244 | 535-860 of WT, K591R | 604 | 605 |
| PDE5DD-245 | 535-860 of WT, F559S, Y709C, M760T | 606 | 607 |
| PDE5DD-246 | 535-860 of WT, A649V, A650T, K730E, E830K | 608 | 609 |
| PDE5DD-247 | 535-860 of WT, Y728C, Q817R | 610 | 611 |
| PDE5DD-248 | 535-860 of WT, L595P, K741R | 612 | 613 |
| PDE5DD-249 | 535-860 of WT, R577W, W615R, M805T, I821V | 614 | 615 |

In one embodiment, the SRE may include at least one PDE5-derived destabilizing domain (DD) such as, but not limited to, PDE5DD-1, PDE5DD-2, PDE5DD-3, PDE5DD-4, PDE5DD-5, PDE5DD-6, PDE5DD-7, PDE5DD-8, PDE5DD-9, PDE5DD-10, PDE5DD-11, PDE5DD-12, PDE5DD-13, PDE5DD-14, PDE5DD-15, PDE5DD-16, PDE5DD-17, PDE5DD-18, PDE5DD-19, PDE5DD-20, PDE5DD-21, PDE5DD-22, PDE5DD-23, PDE5DD-24, PDE5DD-25, PDE5DD-26, PDE5DD-27, PDE5DD-28, PDE5DD-29, PDE5DD-30, PDE5DD-31, PDE5DD-32, PDE5DD-33, PDE5DD-34, PDE5DD-35, PDE5DD-36, PDE5DD-37, PDE5DD-38, PDE5DD-39, PDE5DD-40, PDE5DD-41, PDE5DD-42, PDE5DD-43, PDE5DD-44, PDE5DD-45, PDE5DD-46, PDE5DD-47, PDE5DD-48, PDE5DD-49, PDE5DD-50, PDE5DD-51, PDE5DD-52, PDE5DD-53, PDE5DD-54, PDE5DD-55, PDE5DD-56, PDE5DD-57, PDE5DD-58, PDE5DD-59, PDE5DD-60, PDE5DD-61, PDE5DD-62, PDE5DD-63, PDE5DD-64, PDE5DD-65, PDE5DD-66, PDE5DD-67, PDE5DD-68, PDE5DD-69, PDE5DD-70, PDE5DD-71, PDE5DD-72, PDE5DD-73, PDE5DD-74, PDE5DD-75, PDE5DD-76, PDE5DD-77, PDE5DD-78, PDE5DD-79, PDE5DD-80, PDE5DD-81, PDE5DD-82, PDE5DD-83, PDE5DD-84, PDE5DD-85, PDE5DD-86, PDE5DD-87, PDE5DD-88, PDE5DD-89, PDE5DD-90, PDE5DD-91, PDE5DD-92, PDE5DD-93, PDE5DD-94, PDE5DD-95, PDE5DD-96, PDE5DD-97, PDE5DD-98, PDE5DD-99, PDE5DD-100, PDE5DD-101, PDE5DD-102, PDE5DD-103, PDE5DD-104, PDE5DD-105, PDE5DD-106, PDE5DD-107, PDE5DD-108, PDE5DD-109, PDE5DD-110, PDE5DD-111, PDE5DD-112, PDE5DD-113, PDE5DD-114, PDE5DD-115, PDE5DD-116, PDE5DD-117, PDE5DD-118, PDE5DD-119, PDE5DD-120, PDE5DD-121, PDE5DD-122, PDE5DD-123, PDE5DD-124, PDE5DD-125, PDE5DD-126, PDE5DD-127, PDE5DD-128, PDE5DD-129, PDE5DD-130, PDE5DD-131, PDE5DD-132, PDE5DD-133, PDE5DD-134, PDE5DD-135, PDE5DD-136, PDE5DD-137, PDE5DD-138, PDE5DD-139, PDE5DD-140, PDE5DD-141, PDE5DD-142, PDE5DD-143, PDE5DD-144, PDE5DD-145, PDE5DD-146, PDE5DD-147, PDE5DD-148, PDE5DD-149, PDE5DD-150, PDE5DD-151, PDE5DD-152, PDE5DD-153, PDE5DD-154, PDE5DD-155, PDE5DD-156, PDE5DD-157, PDE5DD-158, PDE5DD-159, PDE5DD-160, PDE5DD-161, PDE5DD-162, PDE5DD-163, PDE5DD-164, PDE5DD-165, PDE5DD-166, PDE5DD-167, PDE5DD-168, PDE5DD-169, PDE5DD-170, PDE5DD-171, PDE5DD-172, PDE5DD-173, PDE5DD-174, PDE5DD-175, PDE5DD-176, PDE5DD-177, PDE5DD-178, PDE5DD-179, PDE5DD-180, PDE5DD-181, PDE5DD-182, PDE5DD-183, PDE5DD-184, PDE5DD-185, PDE5DD-186, PDE5DD-187, PDE5DD-188, PDE5DD-189, PDE5DD-190, PDE5DD-191, PDE5DD-192, PDE5DD-193, PDE5DD-194, PDE5DD-195, PDE5DD-196, PDE5DD-197, PDE5DD-198, PDE5DD-199, PDE5DD-200, PDE5DD-201, PDE5DD-202, PDE5DD-203, PDE5DD-204, PDE5DD-205, PDE5DD-206, PDE5DD-207, PDE5DD-208, PDE5DD-209, PDE5DD-210, PDE5DD-211, PDE5DD-212, PDE5DD-213, PDE5DD-214, PDE5DD-215, PDE5DD-216, PDE5DD-217, PDE5DD-218, PDE5DD-219, PDE5DD-220, PDE5DD-221, PDE5DD-222, PDE5DD-223, PDE5DD-224, PDE5DD-225, PDE5DD-226, PDE5DD-227, PDE5DD-228, PDE5DD-229, PDE5DD-230, PDE5DD-231, PDE5DD-232, PDE5DD-233, PDE5DD-234, PDE5DD-235, PDE5DD-236, PDE5DD-237, PDE5DD-238, PDE5DD-239, PDE5DD-240, PDE5DD-241, PDE5DD-242, PDE5DD-243, PDE5DD-244, PDE5DD-245, PDE5DD-246, PDE5DD-247, PDE5DD-248, or PDE5DD-249.

In one embodiment, the DD in the SRE may be derived from a PDE protein and include the mutation R732L and include the region of amino acid 535-860 of WT (DD identifier: PDE5DD-7). As a non-limiting example, the amino acid sequence of the DD is provided as SEQ ID NO: 80 (exemplary nucleic acid sequence provided as SEQ ID NO: 81-84).

In one embodiment, the DD in the SRE may be derived from a PDE protein and include the mutation R732L and include the region of amino acid 590-860 of WT (DD identifier: PDE5DD-124). As a non-limiting example, the amino acid sequence of the DD is provided as SEQ ID NO: 274 (exemplary nucleic acid sequence provided as SEQ ID NO: 275).

In one embodiment, the DD in the SRE may be derived from a PDE protein and include the mutation R732L and include the region of amino acid 567-860 of WT (DD identifier: PDE5DD-125). As a non-limiting example, the amino acid sequence of the DD is provided as SEQ ID NO: 276 (exemplary nucleic acid sequence provided as SEQ ID NO: 277).

In one embodiment, the DD in the SRE may be derived from a PDE protein and include the mutation R732G and include the region of amino acid 590-836 of WT (DD identifier: PDE5DD-126). As a non-limiting example, the amino acid sequence of the DD is provided as SEQ ID NO: 278 (exemplary nucleic acid sequence provided as SEQ ID NO: 279).

In one embodiment, the DD in the SRE may be derived from a PDE protein and include the mutation R732A and include the region of amino acid 590-836 of WT (DD identifier: PDE5DD-127). As a non-limiting example, the amino acid sequence of the DD is provided as SEQ ID NO: 280 (exemplary nucleic acid sequence provided as SEQ ID NO: 281).

In one embodiment, the DD in the SRE may be derived from a PDE protein and include the mutation R732V and include the region of amino acid 590-836 of WT (DD identifier: PDE5DD-128). As a non-limiting example, the amino acid sequence of the DD is provided as SEQ ID NO: 282 (exemplary nucleic acid sequence provided as SEQ ID NO: 283).

In one embodiment, the DD in the SRE may be derived from a PDE protein and include the mutation R732I and include the region of amino acid 590-836 of WT (DD identifier: PDE5DD-129). As a non-limiting example, the amino acid sequence of the DD is provided as SEQ ID NO: 284 (exemplary nucleic acid sequence provided as SEQ ID NO: 285).

In one embodiment, the DD in the SRE may be derived from a PDE protein and include the mutation R732P and include the region of amino acid 590-836 of WT (DD identifier: PDE5DD-130). As a non-limiting example, the amino acid sequence of the DD is provided as SEQ ID NO: 286 (exemplary nucleic acid sequence provided as SEQ ID NO: 287).

In one embodiment, the DD in the SRE may be derived from a PDE protein and include the mutation R732F and include the region of amino acid 590-836 of WT (DD identifier: PDE5DD-131). As a non-limiting example, the amino acid sequence of the DD is provided as SEQ ID NO: 288 (exemplary nucleic acid sequence provided as SEQ ID NO: 289).

In one embodiment, the DD in the SRE may be derived from a PDE protein and include the mutation R732W and include the region of amino acid 590-836 of WT (DD identifier: PDE5DD-132). As a non-limiting example, the amino acid sequence of the DD is provided as SEQ ID NO: 290 (exemplary nucleic acid sequence provided as SEQ ID NO: 291).

In one embodiment, the DD in the SRE may be derived from a PDE protein and include the mutation R732Y and include the region of amino acid 590-836 of WT (DD identifier: PDE5DD-133). As a non-limiting example, the amino acid sequence of the DD is provided as SEQ ID NO: 292 (exemplary nucleic acid sequence provided as SEQ ID NO: 293).

In one embodiment, the DD in the SRE may be derived from a PDE protein and include the mutation R732H and include the region of amino acid 590-836 of WT (DD identifier: PDE5DD-134). As a non-limiting example, the amino acid sequence of the DD is provided as SEQ ID NO: 294 (exemplary nucleic acid sequence provided as SEQ ID NO: 295).

In one embodiment, the DD in the SRE may be derived from a PDE protein and include the mutation R732S and include the region of amino acid 590-836 of WT (DD identifier: PDE5DD-135). As a non-limiting example, the amino acid sequence of the DD is provided as SEQ ID NO: 296 (exemplary nucleic acid sequence provided as SEQ ID NO: 297).

In one embodiment, the DD in the SRE may be derived from a PDE protein and include the mutation R732T and include the region of amino acid 590-836 of WT (DD identifier: PDE5DD-136). As a non-limiting example, the amino acid sequence of the DD is provided as SEQ ID NO: 298 (exemplary nucleic acid sequence provided as SEQ ID NO: 299).

In one embodiment, the DD in the SRE may be derived from a PDE protein and include the mutation R732D and include the region of amino acid 590-836 of WT (DD identifier: PDE5DD-137). As a non-limiting example, the amino acid sequence of the DD is provided as SEQ ID NO: 300 (exemplary nucleic acid sequence provided as SEQ ID NO: 301).

In one embodiment, the DD in the SRE may be derived from a PDE protein and include the mutation R732E and include the region of amino acid 590-836 of WT (DD identifier: PDE5DD-138). As a non-limiting example, the amino acid sequence of the DD is provided as SEQ ID NO: 302 (exemplary nucleic acid sequence provided as SEQ ID NO: 303).

In one embodiment, the DD in the SRE may be derived from a PDE protein and include the mutation R732Q and include the region of amino acid 590-836 of WT (DD identifier: PDE5DD-139). As a non-limiting example, the amino acid sequence of the DD is provided as SEQ ID NO: 304 (exemplary nucleic acid sequence provided as SEQ ID NO: 305).

In one embodiment, the DD in the SRE may be derived from a PDE protein and include the mutation R732N and include the region of amino acid 590-836 of WT (DD identifier: PDE5DD-140). As a non-limiting example, the amino acid sequence of the DD is provided as SEQ ID NO: 306 (exemplary nucleic acid sequence provided as SEQ ID NO: 307).

In one embodiment, the DD in the SRE may be derived from a PDE protein and include the mutation R732M and include the region of amino acid 590-836 of WT (DD identifier: PDE5DD-141). As a non-limiting example, the amino acid sequence of the DD is provided as SEQ ID NO: 308 (exemplary nucleic acid sequence provided as SEQ ID NO: 309).

In one embodiment, the DD in the SRE may be derived from a PDE protein and include the mutation R732C and include the region of amino acid 590-836 of WT (DD identifier: PDE5DD-142). As a non-limiting example, the amino acid sequence of the DD is provided as SEQ ID NO: 310 (exemplary nucleic acid sequence provided as SEQ ID NO: 311).

In one embodiment, the DD in the SRE may be derived from a PDE protein and include the mutation R732K and include the region of amino acid 590-836 of WT (DD identifier: PDE5DD-143). As a non-limiting example, the amino acid sequence of the DD is provided as SEQ ID NO: 312 (exemplary nucleic acid sequence provided as SEQ ID NO: 313).

In one embodiment, the DD in the SRE may be derived from a PDE protein and include the mutation R732L and include the region of amino acid 590-836 of WT (DD identifier: PDE5DD-144). As a non-limiting example, the amino acid sequence of the DD is provided as SEQ ID NO: 314 (exemplary nucleic acid sequence provided as SEQ ID NO: 315).

In one embodiment, the DD in the SRE may be derived from a PDE protein and include the mutation R732L and include the region of amino acid 535-836 of WT (DD identifier: PDE5DD-145). As a non-limiting example, the amino acid sequence of the DD is provided as SEQ ID NO: 316 (exemplary nucleic acid sequence provided as SEQ ID NO: 317).

In one embodiment, the DD in the SRE may be derived from a PDE protein and include the mutation Y612F, R732L and include the region of amino acid 535-860 of WT (DD identifier: PDE5DD-146). As a non-limiting example, the amino acid sequence of the DD is provided as SEQ ID NO: 318 (exemplary nucleic acid sequence provided as SEQ ID NO: 319).

In one embodiment, the DD in the SRE may be derived from a PDE protein and include the mutation Y612W, R732L and include the region of amino acid 535-860 of WT (DD identifier: PDE5DD-147). As a non-limiting example, the amino acid sequence of the DD is provided as SEQ ID NO: 320 (exemplary nucleic acid sequence provided as SEQ ID NO: 321).

In one embodiment, the DD in the SRE may be derived from a PDE protein and include the mutation Y612A, R732L and include the region of amino acid 535-860 of WT (DD identifier: PDE5DD-148). As a non-limiting example, the amino acid sequence of the DD is provided as SEQ ID NO: 322 (exemplary nucleic acid sequence provided as SEQ ID NO: 323).

In one embodiment, the DD in the SRE may be derived from a PDE protein and include the mutation R732L, D764N and include the region of amino acid 535-860 of WT (DD identifier: PDE5DD-150). As a non-limiting example, the amino acid sequence of the DD is provided as SEQ ID NO: 326 (exemplary nucleic acid sequence provided as SEQ ID NO: 327).

In one embodiment, the DD in the SRE may be derived from a PDE protein and include the mutation R732L, F736A and include the region of amino acid 535-860 of WT (DD identifier: PDE5DD-151). As a non-limiting example, the amino acid sequence of the DD is provided as SEQ ID NO: 328 (exemplary nucleic acid sequence provided as SEQ ID NO: 329, 470).

In one embodiment, the DD in the SRE may be derived from a PDE protein and include the mutation H653A, R732L and include the region of amino acid 535-860 of WT (DD identifier: PDE5DD-152). As a non-limiting example, the amino acid sequence of the DD is provided as SEQ ID NO: 330 (exemplary nucleic acid sequence provided as SEQ ID NO: 331).

In one embodiment, the DD in the SRE may be derived from a PDE protein and include the mutation R732L, D764A and include the region of amino acid 535-860 of WT (DD identifier: PDE5DD-153). As a non-limiting example, the amino acid sequence of the DD is provided as SEQ ID NO: 332 (exemplary nucleic acid sequence provided as SEQ ID NO: 333).

In one embodiment, the DD in the SRE may be derived from a PDE protein and include the mutation E682A, R732L and include the region of amino acid 535-860 of WT (DD identifier: PDE5DD-170). As a non-limiting example, the amino acid sequence of the DD is provided as SEQ ID NO: 366 (exemplary nucleic acid sequence provided as SEQ ID NO: 367).

In one embodiment, the DD in the SRE may be derived from a PDE protein and include the mutation D724A, R732L and include the region of amino acid 535-860 of WT (DD identifier: PDE5DD-171). As a non-limiting example, the amino acid sequence of the DD is provided as SEQ ID NO: 368 (exemplary nucleic acid sequence provided as SEQ ID NO: 369).

Estrogen Receptor (ER) Derived Destabilizing Domains (DDs)

In one embodiment, the SRE may include at least one destabilizing domain (DD) derived from an Estrogen Receptor (ER) protein or a fragment or variant thereof.

In one embodiment, the SRE comprises a region of the ER protein.

In one embodiment, the DD may be derived from an ER protein and include at least one mutation.

In one embodiment, the DD may be derived from an ecDHFR protein and include more than one mutation.

In some embodiments, DDs derived from ecDHFR may comprise amino acids 2-595 of the parent ER sequence. This is referred to herein as an M1del mutation.

In one embodiment, the stimulus is a small molecule that binds to a SRE to post-translationally regulate protein levels.

In some embodiments, DDs derived from ER may comprise amino acids 2-875 of the parent ER sequence. This is referred to herein as an M1del mutation.

In some embodiments, DDs are derived from a region of the ER protein. As a non-limiting example, the region is amino acid 305-549 of ER (SEQ ID NO. 65).

Ligands

Ligands such as small molecules that are well known to bind candidate proteins can be tested for their regulation in protein responses. The small molecules may be clinically approved to be safe and have appropriate pharmaceutical kinetics and distribution. In some embodiments, the stimulus is a ligand of a destabilizing domain (DD), for example, a small molecule that binds a destabilizing domain and stabilizes the POI fused to the destabilizing domain.

Stabilization and Destabilization Ratio

In some embodiments, the present disclosure provides methods for modulating protein expression, function or level by measuring the stabilization ratio and destabilization ratio. As used herein, the stabilization ratio may be defined as the ratio of expression, function or level of a protein of interest in response to the stimulus to the expression, function or level of the protein of interest in the absence of the stimulus specific to the SRE. In some aspects, the stabilization ratio is at least 1, such as by at least 1-10, 1-20, 1-30, 1-40, 1-50, 1-60, 1-70, 1-80, 1-90, 1-100, 20-30, 20-40, 20-50, 20-60, 20-70, 20-80, 20-90, 20-95, 20-100, 30-40, 30-50, 30-60, 30-70, 30-80, 30-90, 30-95, 30-100, 40-50, 40-60, 40-70, 40-80, 40-90, 40-95, 40-100, 50-60, 50-70, 50-80, 50-90, 50-95, 50-100, 60-70, 60-80, 60-90, 60-95, 60-100, 70-80, 70-90, 70-95, 70-100, 80-90, 80-95, 80-100, 90-95, 90-100 or 95-100. As used herein, the destabilization ratio may be defined as the ratio of expression, function or level of a protein of interest in the absence of the stimulus specific to the effector module to the expression, function or level of the protein of interest, that is expressed constitutively and in the absence of the stimulus specific to the SRE. As used herein "constitutively" refers to the expression, function or level of a protein of interest that is not linked to an SRE, and is therefore expressed both in the presence and absence of the stimulus. In some aspects, the destabilization ratio is at least 0, such as by at least 0.1, 0.2, 0.3, 0.4, 0.5, 0.6, 0.7, 0.8, 0.9, or at least, 0-0.1, 0-0.2, 0-0.3, 0-0.4, 0-0.5, 0-0.6, 0-0.7, 0-0.8, 0-0.9, 0.1-0.2, 0.1-0.3, 0.1-0.4, 0.1-0.5, 0.1-0.6, 0.1-0.7, 0.1-0.8, 0.1-0.9, 0.2-0.3, 0.2-0.4, 0.2-0.5, 0.2-0.6, 0.2-0.7, 0.2-0.8, 0.2-0.9, 0.3-0.4, 0.3-0.5, 0.3-0.6, 0.3-0.7, 0.3-0.8, 0.3-0.9, 0.4-0.5, 0.4-0.6, 0.4-0.7, 0.4-0.8, 0.4-0.9, 0.5-0.6, 0.5-0.7, 0.5-0.8, 0.5-0.9, 0.6-0.7, 0.6-0.8, 0.6-0.9, 0.7-0.8, 0.7-0.9 or 0.8-0.9.

In some embodiments, the SRE of the effector module may stabilize the payload of interest by a stabilization ratio of 1 or more, wherein the stabilization ratio may comprise the ratio of expression, function or level of the payload of interest in the presence of the stimulus to the expression, function or level of the payload of interest in the absence of the stimulus.

In some embodiments, the SRE may destabilize the immunotherapeutic agent by a destabilization ratio between 0, and 0.09, wherein the destabilization ratio may comprise the ratio of expression, function or level of the payload of interest in the absence of the stimulus specific to the SRE to the expression, function or level of the payload of interest that is expressed constitutively, and in the absence of the stimulus specific to the SRE.

Protein-Protein Interactions

In some embodiments, the stimulus response element may be destabilized by the stimulus. In some embodiments, SREs may be derived from protein complexes that comprise at least one protein-protein interaction. In other aspects, the SRE may form a protein-protein interaction with a natural protein within the cell. Protein complexes reduce the exposure of the constituent proteins to the risk of undesired oligomerization by reducing the concentration of the free monomeric state. Payloads appended to such SREs may be stabilized in the absence of the stimulus. In some aspects, the stimulus may be a small molecule that is capable of interrupting or disrupting the protein-protein interactions related to the SRE. In such instances, addition of the stimulus, results in the reduced expression and/or function of the payload. In some embodiments, stimuli that induce conformational change of the SRE may be utilized. In one aspect, the SRE may be stabilized by the conformational change. In another aspect, the SRE may be destabilized by the conformational change. The stimuli may also be small molecules that disrupt post translational modification of SREs which may result in the disruption of the protein-protein interaction related to the SRE. In some embodiments, SREs may be identified using protein interatomic techniques known in the art. Such methods may enable the identification of protein interactions that are therapeutically relevant.

Molecular Switches in Biocircuits, Genetic Circuits

Molecular Switches

In some embodiments, the DDs described herein can include aspects of molecular switches. Alternatively or additionally, molecular switches can be constructed using DDs as described. The term "molecular switch" as used herein refers to any molecule that can be reversibly shifted between two or more stable states in response to a stimulus (e.g., a ligand). Molecular switches can be employed in biocircuits or genetic circuits, i.e., engineered input-responsive biological circuits.

Safety Switches

In some embodiments, effector module payloads can comprise DD-regulated safety switches that can eliminate adoptively transferred cells in the case of severe toxicity, thereby mitigating the adverse effects of T cell therapy. Adoptively transferred T cells in immunotherapy can attack normal cells in response to normal tissue expression of TAA.

Even on-tumor target activity of adoptively transferred T cells can result in toxicities such as tumor lysis syndrome, cytokine release syndrome and the related macrophage activation syndrome. Safety switches can be utilized to eliminate inappropriately activated adoptively transferred cells by induction of apoptosis or by immunosurveillance.

Regulatory Switches

The utility of adoptive cell therapy (ACT) has been limited by the high incidence of graft versus host disease (GVHD). GVHD occurs when adoptively transferred T cells elicit an immune response resulting in host tissue damage. Recognition of host antigens by the graft cells triggers a proinflammatory cytokine storm cascade that signifies acute GVHD. GVHD is characterized as an imbalance between the effector and the regulatory arms of the immune system. In some embodiments, the payloads described herein can be used as regulatory switches. As used herein "regulatory switch" refers proteins, which when expressed in target cells increase tolerance to the graft by enhancing the regulatory arm of the immune system.

In one embodiment, regulatory switches can include DD-regulated payloads that preferentially promote the expansion of regulatory T (Treg) cells. Tregs are a distinct population of cells that are positively selected on high affinity ligands in the thymus and play an important role in the tolerance to self-antigens. In addition, Tregs have also been shown to play a role in peripheral tolerance to foreign antigens. Since Tregs promote immune tolerance, expansion of Tregs with compositions as described herein can be desirable to limit GVHD.

Additional Effector Module Features

The effector module of the present disclosure may further comprise a signal sequence which regulates the distribution of the payload of interest, a cleavage and/or processing feature which facilitate cleavage of the payload from the effector module construct, a targeting and/or penetrating signal which can regulate the cellular localization of the effector module, a tag, and/or one or more linker sequences which link different components of the effector module.

Signal sequences

In addition to the SRE and payload region, effector modules of the disclosure may further comprise one or more additional features such as one or more signal sequences.

Signal sequences (sometimes referred to as signal peptides, targeting signals, target peptides, localization sequences, transit peptides, leader sequences or leader peptides) direct proteins (e.g., the effector module of the present disclosure) to their designated cellular and/or extracellular locations. Protein signal sequences play a central role in the targeting and translocation of nearly all secreted proteins and many integral membrane proteins.

A signal sequence is a short (5-30 amino acids long) peptide present at the N-terminus of the majority of newly synthesized proteins that are destined towards a particular location. Signal sequences can be recognized by signal recognition particles (SRPs) and cleaved using type I and type II signal peptide peptidases. Signal sequences derived from human proteins can be incorporated as a regulatory module of the effector module to direct the effector module to a particular cellular and/or extracellular location.

In some embodiments, a signal sequence may be, although not necessarily, located at the N-terminus or C-terminus of the effector module, and may be, although not necessarily, cleaved off the desired effector module to yield a "mature" payload.

In some embodiments, the signal sequence used herein may exclude the methionine at the position 1 of amino acid sequence of the signal sequence. This may be referred to as an M1del mutation.

In addition to signal sequences naturally occurring such as from a secreted protein, a signal sequence may be a variant modified from a known signal sequence of a protein.

In some instances, the secreted signal sequences may be cytokine signal sequences such as, but not limited to, IL2 signal sequence or a p40 signal sequence.

In some instances, signal sequences directing the payload of interest to the surface membrane of the target cell may be used. Expression of the payload on the surface of the target cell may be useful to limit the diffusion of the payload to non-target in vivo environments, thereby potentially improving the safety profile of the payloads. Additionally, the membrane presentation of the payload may allow for physiologically and qualitative signaling as well as stabilization and recycling of the payload for a longer half-life. Membrane sequences may be the endogenous signal sequence of the N terminal component of the payload of interest. Optionally, it may be desirable to exchange this sequence for a different signal sequence. Signal sequences may be selected based on their compatibility with the secretory pathway of the cell type of interest so that the payload is presented on the surface of the T cell. In some embodiments, the signal sequence may be IgE signal sequence, CD8a signal sequence (also referred to as CD8a leader), or IL15Ra signal sequence (also referred to as IL15Ra leader) or M1del CD8a signal sequence (also referred to as M1del CD8 leader sequence).

In some embodiments, the signal sequence may exclude the leading methionine present at amino acid position 1 of the signal sequence. In one embodiment, the SRE may include a signal sequence lacking methionine at position such as those from or derived from CD8, referred to herein as SS-912 (Amino Acid SEQ ID NO: 629 or those from or derived from IL12, referred to as SS-914 (Amino Acid SEQ ID NO: 632).

Cleavage Sites

In some embodiments, the effector module comprises a cleavage and/or processing feature.

The effector module of the present disclosure may include at least one protein cleavage signal/site. The protein cleavage signal/site may be located at the N-terminus, the C-terminus, at any space between the N- and the C-termini such as, but not limited to, half-way between the N- and C-termini, between the N-terminus and the half-way point, between the half-way point and the C-terminus, and combinations thereof.

The effector module may include one or more cleavage signal(s)/site(s) of any proteinases. The proteinases may be a serine proteinase, a cysteine proteinase, an endopeptidase, a dipeptidase, a metalloproteinase, a glutamic proteinase, a threonine proteinase and an aspartic proteinase. In some aspects, the cleavage site may be a signal sequence of furin, actinidain, calpain-1, carboxypeptidase A, carboxypeptidase P, carboxypeptidase Y, caspase-1, caspase-2, caspase-3, caspase-4, caspase-5, caspase-6, caspase-7, caspase-8, caspase-9, caspase-10, cathepsin B, cathepsin C, cathepsin G, cathepsin H, cathepsin K, cathepsin L, cathepsin S, cathepsin V, clostripain, chymase, chymotrypsin, elastase, endoproteinase, enterokinase, factor Xa, formic acid, granzyme B, Matrix metallopeptidase-2, Matrix metallopeptidase-3, pepsin, proteinase K, SUMO protease, subtilisin, TEV protease, thermolysin, thrombin, trypsin and TAGZyme.

Tags

In some embodiments, the effector module comprises a protein tag.

The protein tag may be used for detecting and monitoring the process of the effector module. The effector module may include one or more tags such as an epitope tag (e.g., a FLAG or hemagglutinin (HA) tag). A large number of protein tags may be used for the present effector modules. They include, but are not limited to, self-labeling polypeptide tags (e.g., haloalkane dehalogenase (halotag2 or halotag7), ACP tag, clip tag, MCP tag, snap tag), epitope tags (e.g., FLAG, HA, His, and Myc), fluorescent tags (e.g., green fluorescent protein (GFP), red fluorescent protein (RFP), yellow fluorescent protein (YFP), and its variants), bioluminescent tags (e.g. luciferase and its variants), affinity tags (e.g., maltose-binding protein (MBP) tag, glutathione-S-transferase (GST) tag), immunogenic affinity tags (e.g., protein A/G, IRS, AU1, AU5, glu-glu, KT3, S-tag, HSV, VSV-G, Xpress and V5), and other tags (e.g., biotin (small molecule), StrepTag (StrepII), SBP, biotin carboxyl carrier protein (BCCP), eXact, CBP, CYD, HPC, CBD intein-chitin binding domain, Trx, NorpA, and NusA.

Linkers

In some embodiments, the effector module comprises a linker.

In some embodiments, the effector module of the disclosure may further comprise a linker sequence. The linker region serves primarily as a spacer between two or more polypeptides within the effector module. The "linker" or "spacer", as used herein, refers to a molecule or group of molecules that connects two molecules, or two parts of a molecule such as two domains of a recombinant protein.

In some embodiments, "Linker" (L) or "linker domain" or "linker region" or "linker module" or "peptide linker" as used herein refers to an oligo- or polypeptide region of from about 1 to 100 amino acids in length, which links together any of the domains/regions of the effector module (also called peptide linker). The peptide linker may be 1-40 amino acids in length, or 2-30 amino acids in length, or 20-80 amino acids in length, or 50-100 amino acids in length. Linker length may also be optimized depending on the type of payload utilized and based on the crystal structure of the payload. In some instances, a shorter linker length may be preferably selected. In some aspects, the peptide linker is made up of amino acids linked together by peptide bonds, preferably from 1 to 20 amino acids linked by peptide bonds, wherein the amino acids are selected from the 20 naturally occurring amino acids: Glycine (G), Alanine (A), Valine (V), Leucine (L), Isoleucine (I), Serine (S), Cysteine (C), Threonine (T), Methionine (M), Proline (P), Phenylalanine (F), Tyrosine (Y), Tryptophan (W), Histidine (H), Lysine (K), Arginine (R), Aspartate (D), Glutamic acid (E), Asparagine (N), and Glutamine (Q). One or more of these amino acids may be glycosylated, as is understood by those in the art. In some aspects, amino acids of a peptide linker may be selected from Alanine (A), Glycine (G), Proline (P), Asparagine (R), Serine (S), Glutamine (Q) and Lysine (K).

In one example, an artificially designed peptide linker may preferably be composed of a polymer of flexible residues like Glycine (G) and Serine (S) so that the adjacent protein domains are free to move relative to one another. Longer linkers may be used when it is desirable to ensure that two adjacent domains do not interfere with one another. The choice of a particular linker sequence may concern if it affects biological activity, stability, folding, targeting and/or pharmacokinetic features of the fusion construct.

In other examples, a peptide linker may be made up of a majority of amino acids that are sterically unhindered, such as Glycine (G) and Alanine (A). Exemplary linkers are polyglycines (such as $(G)_4$ (SEQ ID NO. 419), $(G)_5$ (SEQ ID NO. 423), $(G)_8$ (SEQ ID NO. 420)), poly(GA), and polyalanines. The linkers described herein are exemplary, and linkers that are much longer and which include other residues are contemplated by the present disclosure.

A linker sequence may be a natural linker derived from a multi-domain protein. A natural linker is a short peptide sequence that separates two different domains or motifs within a protein.

In some aspects, linkers may be flexible or rigid. In other aspects, linkers may be cleavable or non-cleavable. As used herein, the terms "cleavable linker domain or region" or "cleavable peptide linker" are used interchangeably. In some embodiments, the linker sequence may be cleaved enzymatically and/or chemically. Examples of enzymes (e.g., proteinase/peptidase) useful for cleaving the peptide linker include, but are not limited, to Arg-C proteinase, Asp-N endopeptidase, chymotrypsin, clostripain, enterokinase, Factor Xa, glutamyl endopeptidase, Granzyme B, Achromobacter proteinase I, pepsin, proline endopeptidase, proteinase K, Staphylococcal peptidase I, thermolysin, thrombin, trypsin, and members of the Caspase family of proteolytic enzymes (e.g. Caspases 1-10). Chemical sensitive cleavage sites may also be included in a linker sequence. Examples of chemical cleavage reagents include, but are not limited to, cyanogen bromide, which cleaves methionine residues; N-chloro succinimide, iodobenzoic acid or BNPS-skatole (2-(2-nitrophenylsulfenyl)-3-methylindole), which cleaves tryptophan residues; dilute acids, which cleave at aspartyl-prolyl bonds; and e aspartic acid-proline acid cleavable recognition sites (i.e., a cleavable peptide linker comprising one or more D-P dipeptide moieties). The fusion module may include multiple regions encoding peptides of interest separated by one or more cleavable peptide linkers.

In other embodiments, a cleavable linker may be a "self-cleaving" linker peptide, such as 2A linkers (for example T2A), 2A-like linkers or functional equivalents thereof and combinations thereof. In some embodiments, the linkers include the picornaviral 2A-like linker, CHYSEL sequences of porcine teschovirus (P2A), Thosea asigna virus (T2A) or combinations, variants and functional equivalents thereof. Other linkers will be apparent to those skilled in the art and may be used in connection with alternate embodiments of the disclosure. In some embodiments, the biocircuits of the present disclosure may include 2A peptides. The 2A peptide is a sequence of about 20 amino acid residues from a virus that is recognized by a protease (2A peptidases) endogenous to the cell.

The linkers of the present disclosure may also be non-peptide linkers. For example, alkyl linkers such as —NH—$(CH_2)$ a-C(O)—, wherein a=2-20 can be used. These alkyl linkers may further be substituted by any non-sterically hindering group such as lower alkyl (e.g., $C_1$-$C_6$) lower acyl, halogen (e.g., Cl, Br), CN, $NH_2$, phenyl, etc.

In one embodiment, the linker may be a BamHI site. As a non-limiting example, the BamHI site has the amino acid sequence GS and/or the DNA sequence GGATCC.

Targeting or Penetrating Peptides

In some embodiments, the effector module comprises a targeting and/or penetrating peptide.

Small targeting and/or penetrating peptides that selectively recognize cell surface markers (e.g. receptors, transmembrane proteins, and extra-cellular matrix molecules) can be employed to target the effector module to the desired organs, tissues or cells. Short peptides (5-50 amino acid residues) synthesized in vitro and naturally occurring peptides, or analogs, variants, derivatives thereof, may be incorporated into the effector module for homing the effector module to the desired organs, tissues and cells, and/or subcellular locations inside the cells.

In some embodiments, a targeting sequence and/or penetrating peptide may be included in the effector module to drive the effector module to a target organ, or a tissue, or a cell (e.g., a cancer cell). In other embodiments, a targeting and/or penetrating peptide may direct the effector module to a specific subcellular location inside a cell.

A targeting peptide has any number of amino acids from about 6 to about 30 inclusive. The peptide may have 6, 7, 8, 9, 10, 11, 12, 13, 14, 15, 16, 17, 18, 19, 20, 21, 22, 23, 24, 25, 26, 27, 28, 29 or 30 amino acids. Generally, a targeting peptide may have 25 or fewer amino acids, for example, 20 or fewer, for example 15 or fewer.

Naturally occurring small targeting and/or penetrating peptides that recognize specific tissues or cells bind cell surface molecules (e.g. receptors, trans-membrane proteins) with high affinity, which make them attractive trafficking moieties. Such peptides may include peptide toxins from microbes, insects (e.g. scorpion, honey bee, spider), animals (e.g. snake) and plants, and analogs, variants and derivatives thereof; and secreted peptide hormones, ligands and signal peptides.

In some aspects, analogs, variants and derivatives from natural toxins that abolish their cytotoxic activities may be used as targeting peptides.

Peptides hormones and other signal peptides transfer important messages for cell to cell communications, which selectively bind cells that express their receptors with high affinity. In some aspects, peptide hormones may be included in the effector module.

Targeting and penetrating peptides may also be engineered biomimetic peptides and/or chemically modified small peptides. Numerous peptides with specific motifs and sequences that target specific cells and tissues with high affinity and selectivity in normal or diseased conditions are identified. A synthetic targeting peptide may be up to 30 amino acids in length, or may be longer. A targeting peptide generally has at least about 5 amino acids but may have fewer, for example, 4 amino acids, or 3 amino acids. Generally, a targeting peptide has any number of amino acids from about 6 to about 30 inclusive. The peptide may have 6, 7, 8, 9, 10, 11, 12, 13, 14, 15, 16, 17, 18, 19, 20, 21, 22, 23, 24, 25, 26, 27, 28, 29 or 30 amino acids. Generally, a targeting peptide may have 25 or fewer amino acids, for example, 20 or fewer, for example 15 or fewer.

A chimeric peptide may also be synthesized with fused amino acids from naturally occurring proteins and artificial amino acid sequences.

Payloads

As used herein a "payload" or "target payload" or "payload of interest (POI)" is defined as any protein or nucleic acid whose function is to be altered.

Payloads may include any coding or non-coding gene or any protein or fragment thereof.

Payloads are often associated with one or more SREs and may be encoded alone or in combination with one or more SRE in a polynucleotide of the disclosure. Payloads themselves may be altered (at the protein or nucleic acid level) thereby providing for an added layer of tenability of the effector module. For example, payloads may be engineered or designed to contain mutations, single or multiple, which affect the stability of the payload or its susceptibility to degradation, cleavage or trafficking. The combination of an SRE which can have a spectrum of responses to a stimulus with a payload which is altered to exhibit a variety of responses or gradations of output signals, e.g., expression levels, produce biocircuits which are superior to those in the art. For example, mutations or substitutional designs such as those created for IL-12 in WO2016048903 (specifically in Example 1 therein), the contents of which are incorporated herein by reference in their entirety, may be used in any protein payload in conjunction with an SRE of the present disclosure to create dual tunable biocircuits. The ability to independently tune both the SRE and the payload greatly increases the scope of uses of the effector modules of the present disclosure.

As used herein, the phrase "derived from" as it relates to effector modules, SRE's or payloads means that the effector module, SRE or payload originates at least in part from the stated parent molecule or sequence. For example, in designing an SRE, such SRE may be derived from an epitope or region of a naturally occurring protein but then have been modified in any of the ways taught herein to optimize the SRE function.

In one embodiment, the payload is derived from a region of parent protein or from a mutant protein. The region of the parent protein may be 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, or more than 450 amino acids in length. The region of the parent protein may be 5-50, 25-75, 50-100, 75-125, 100-150, 125-175, 150-200, 175-225, 200-250, 225-275, 250-300, 275-325, 300-350, 325-375, 350-400, 375-425, or 400-450 amino acids in length.

In one embodiment, the payload is derived from a region of parent protein or from a mutant protein and includes a region of the parent protein. The payload may include a region of the parent protein which is 1%, 5%, 10%, 15%, 20%, 25%, 30%, 35%, 40%, 45%, 50%, 55%, 60%, 65%, 70%, 75%, 80%, 85%, 90%, 95%, 99%, or 100%, 5-10%, 10-15%, 15-20%, 20-25%, 25-30%, 30-35%, 35-40%, 40-45%, 45-50%, 50-55%, 55-60%, 60-65%, 65-70%, 70-75%, 75-80%, 80-85%, 85-90%, 90-95%, 95-100%, 10-20%, 20-30%, 30-40%, 40-50%, 50-60%, 60-70%, 70-80%, 80-90%, 90-100%, 10-30%, 20-40%, 30-50%, 40-60%, 50-70%, 60-80%, 70-90%, 80-100%, 10-40%, 20-50%, 30-60%, 40-70%, 50-80%, 60-90%, 70-100%, 10-50%, 20-60%, 30-70%, 40-80%, 50-90%, 60-100%, 10-60%, 20-70%, 30-80%, 40-90%, 50-100%, 10-70%, 20-80%, 30-90%, 40-100%, 10-80%, 20-90%, 30-100%, 10-90%, 20-100%, 25-50%, 50-75%, or 75-100% of the parent protein or mutant protein.

In one embodiment, the payload is derived from a parent protein or from a mutant protein and may have 1%, 5%, 10%, 15%, 20%, 25%, 30%, 35%, 40%, 45%, 50%, 55%, 60%, 65%, 70%, 75%, 80%, 85%, 90%, 95%, 99%, or 100%, 5-10%, 10-15%, 15-20%, 20-25%, 25-30%, 30-35%, 35-40%, 40-45%, 45-50%, 50-55%, 55-60%, 60-65%, 65-70%, 70-75%, 75-80%, 80-85%, 85-90%, 90-95%, 95-100%, 10-20%, 20-30%, 30-40%, 40-50%, 50-60%, 60-70%, 70-80%, 80-90%, 90-100%, 10-30%, 20-40%, 30-50%, 40-60%, 50-70%, 60-80%, 70-90%, 80-100%, 10-40%, 20-50%, 30-60%, 40-70%, 50-80%, 60-90%, 70-100%, 10-50%, 20-60%, 30-70%, 40-80%, 50-90%, 60-100%, 10-60%, 20-70%, 30-80%, 40-90%, 50-100%, 10-70%, 20-80%, 30-90%, 40-100%, 10-80%, 20-90%, 30-100%, 10-90%, 20-100%, 25-50%, 50-75%, or 75-100% identity to the parent protein or mutant protein.

In one embodiment, the transmembrane domain region of a first payload may be replaced with a transmembrane domain, variant or fragment thereof, from a second parent protein.

In one embodiment, the payload and/or parent protein may be, but is not limited to, those listed in Table 4.

Polypeptides and Polypeptides as Payloads

The stimuli, biocircuit components, effector modules, including their SREs and payloads of the present disclosure may exist as a whole polypeptide, a plurality of polypeptides or fragments of polypeptides, which independently may be encoded by one or more nucleic acids, a plurality of nucleic acids, fragments of nucleic acids or variants of any of the aforementioned.

As used herein, the term "polypeptide" refers to a polymer of amino acid residues (natural or unnatural) linked together most often by peptide bonds. The term, as used herein, refers to proteins, polypeptides, and peptides of any size, structure, or function. In some instances, the polypeptide encoded is smaller than about 50 amino acids and the polypeptide is then termed a peptide. If the polypeptide is a peptide, it will be at least about 2, 3, 4, or at least 5 amino acid residues long. Thus, polypeptides include gene products, naturally occurring polypeptides, synthetic polypeptides, homologs, orthologs, paralogs, fragments and other equivalents, variants, and analogs of the foregoing. A polypeptide may be a single molecule or may be a multi-molecular complex such as a dimer, trimer or tetramer. They may also comprise single chain or multichain polypeptides and may be associated or linked. The term polypeptide may also apply to amino acid polymers in which one or more amino acid residues are an artificial chemical analogue of a corresponding naturally occurring amino acid.

As used herein, the term "polypeptide variant" refers to molecules which differ in their amino acid sequence from a native or reference sequence. The amino acid sequence variants may possess substitutions, deletions, and/or insertions at certain positions within the amino acid sequence, as compared to a native or reference sequence. Ordinarily, variants will possess at least about 50% identity (homology) to a native or reference sequence, and preferably, they will be at least about 80%, more preferably at least about 90% identical (homologous) to a native or reference sequence.

In some embodiments "variant mimics" are provided. As used herein, the term "variant mimic" refers to a variant which contains one or more amino acids which would mimic an activated sequence. For example, glutamate may serve as a mimic for phospho-threonine and/or phospho-serine. Alternatively, variant mimics may result in deactivation or in an inactivated product containing the mimic, e.g., phenylalanine may act as an inactivating substitution for tyrosine; or alanine may act as an inactivating substitution for serine. The amino acid sequences of the pharmaceutical compositions, biocircuits, biocircuit components, effector modules including their SREs or payloads of the disclosure may comprise naturally occurring amino acids and as such may be considered to be proteins, peptides, polypeptides, or fragments thereof. Alternatively, the pharmaceutical compositions, biocircuits, biocircuit components, effector modules including their SREs or payloads may comprise both naturally and non-naturally occurring amino acids.

As used herein, the term "amino acid sequence variant" refers to molecules with some differences in their amino acid sequences as compared to a native or starting sequence. The amino acid sequence variants may possess substitutions, deletions, and/or insertions at certain positions within the amino acid sequence. As used herein, the terms "native" or "starting" when referring to sequences are relative terms referring to an original molecule against which a comparison may be made. Native or starting sequences should not be confused with wild type sequences. Native sequences or molecules may represent the wild-type (that sequence found in nature) but do not have to be identical to the wild-type sequence.

Ordinarily, variants will possess at least about 70% homology to a native sequence, and preferably, they will be at least about 80%, more preferably at least about 90% homologous to a native sequence.

As used herein, the term "homology" as it applies to amino acid sequences is defined as the percentage of residues in the candidate amino acid sequence that are identical with the residues in the amino acid sequence of a second sequence after aligning the sequences and introducing gaps, if necessary, to achieve the maximum percent homology. Methods and computer programs for the alignment are well known in the art. It is understood that homology depends on a calculation of percent identity but may differ in value due to gaps and penalties introduced in the calculation.

As used herein, the term "homolog" as it applies to amino acid sequences is meant the corresponding sequence of other species having substantial identity to a second sequence of a second species.

As used herein, the term "analog" is meant to include polypeptide variants which differ by one or more amino acid alterations, e.g., substitutions, additions or deletions of amino acid residues that still maintain the properties of the parent polypeptide.

As used herein, the term "derivative" is used synonymously with the term "variant" and refers to a molecule that has been modified or changed in any way relative to a reference molecule or starting molecule.

The present disclosure contemplates several types of pharmaceutical compositions, biocircuits, biocircuit components, effector modules including their SREs or payloads which are amino acid based including variants and derivatives. These include substitutional, insertional, deletional and covalent variants and derivatives. As such, included within the scope of this disclosure are pharmaceutical compositions, biocircuits, biocircuit components, effector modules including their SREs or payloads comprising substitutions, insertions, additions, deletions and/or covalent modifications. For example, sequence tags or amino acids, such as one or more lysines, can be added to peptide sequences of the disclosure (e.g., at the N-terminal or C-terminal ends). Sequence tags can be used for peptide purification or localization. Lysines can be used to increase peptide solubility or to allow for biotinylation. Alternatively, amino acid residues located at the carboxy and amino terminal regions of the amino acid sequence of a peptide or protein may optionally be deleted providing for truncated sequences. Certain amino acids (e.g., C-terminal or N-terminal residues) may alternatively be deleted depending on the use of the sequence, as for example, expression of the sequence as part of a larger sequence which is soluble, or linked to a solid support.

"Substitutional variants" when referring to proteins are those that have at least one amino acid residue in a native or starting sequence removed and a different amino acid inserted in its place at the same position. The substitutions may be single, where only one amino acid in the molecule has been substituted, or they may be multiple, where two or more amino acids have been substituted in the same molecule.

As used herein, the term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine and leucine for another non-polar residue. Likewise, examples of conservative substitutions include the substitution of one polar (hydrophilic) residue for another such as between arginine and lysine, between glutamine and asparagine, and between glycine and serine. Additionally, the substitution of a basic residue such as lysine, arginine or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, methionine for a polar (hydrophilic) residue such as cysteine, glutamine, glutamic acid or lysine and/or a polar residue for a non-polar residue.

As used herein, the term "insertional variants" when referring to proteins are those with one or more amino acids inserted immediately adjacent to an amino acid at a particular position in a native or starting sequence. As used herein, the term "immediately adjacent" refers to an adjacent amino acid that is connected to either the alpha-carboxy or alpha-amino functional group of a starting or reference amino acid.

As used herein, the term "deletional variants" when referring to proteins, are those with one or more amino acids in the native or starting amino acid sequence removed. Ordinarily, deletional variants will have one or more amino acids deleted in a particular region of the molecule.

As used herein, the term "derivatives," as referred to herein includes variants of a native or starting protein comprising one or more modifications with organic proteinaceous or non-proteinaceous derivatizing agents, and post-translational modifications. Covalent modifications are traditionally introduced by reacting targeted amino acid residues of the protein with an organic derivatizing agent that is capable of reacting with selected side-chains or terminal residues, or by harnessing mechanisms of post-translational modifications that function in selected recombinant host cells. The resultant covalent derivatives are useful in programs directed at identifying residues important for biological activity, for immunoassays, or for the preparation of anti-protein antibodies for immunoaffinity purification of the recombinant glycoprotein. Such modifications are within the ordinary skill in the art and are performed without undue experimentation.

As used herein, the term "domain," when referring to proteins, refers to a motif of a polypeptide having one or more identifiable structural or functional characteristics or properties (e.g., binding capacity, serving as a site for protein-protein interactions.)

As used herein, the term "half-domain," when referring to proteins, refers to a portion of an identified domain having at least half the number of amino acid resides as the domain from which it is derived. It is understood that domains may not always contain an even number of amino acid residues. Therefore, in those cases where a domain contains or is identified to comprise an odd number of amino acids, a half-domain of the odd-numbered domain will comprise the whole number portion or next whole number portion of the domain (number of amino acids of the domain/2+/−0.5 amino acids). For example, a domain identified as a 7 amino acid domain could produce half-domains of 3 amino acids or 4 amino acids (7/2=3.5+/−0.5 being 3 or 4). It is also understood that sub-domains may be identified within domains or half-domains, these subdomains possessing less than all of the structural or functional properties identified in the domains or half domains from which they were derived. It is also understood that the amino acids that comprise any of the domain types herein need not be contiguous along the backbone of the polypeptide (i.e., nonadjacent amino acids may fold structurally to produce a domain, half-domain or subdomain).

As used herein, the terms "site," as it pertains to amino acid based embodiments is used synonymously with "amino acid residue" and "amino acid side chain". A site represents a position within a peptide or polypeptide that may be modified, manipulated, altered, derivatized or varied within the polypeptide based molecules of the present disclosure.

As used herein, the terms "termini" or "terminus," when referring to proteins refers to an extremity of a peptide or polypeptide. Such extremity is not limited only to the first or final site of the peptide or polypeptide but may include additional amino acids in the terminal regions. The polypeptide based molecules of the present disclosure may be characterized as having both an N-terminus (terminated by an amino acid with a free amino group (NH2)) and a C-terminus (terminated by an amino acid with a free carboxyl group (COOH)).

Polypeptides or proteins of the disclosure are in some cases made up of multiple polypeptide chains brought together by disulfide bonds or by non-covalent forces (multimers, oligomers). These sorts of proteins will have multiple N- and C-termini. Alternatively, the termini of the polypeptides may be modified such that they begin or end, as the case may be, with a non-polypeptide based moiety such as an organic conjugate.

Once any of the features have been identified or defined as a component of a biocircuit system component, stimulus, effector module including the SREs or payloads of the disclosure, any of several manipulations and/or modifications of these features may be performed by moving, swapping, inverting, deleting, randomizing or duplicating. Furthermore, it is understood that manipulation of features may result in the same outcome as a modification to the compositions of the disclosure. For example, a manipulation which involved deleting a domain would result in the alteration of the length of a molecule just as modification of a nucleic acid to encode less than a full-length molecule would.

Modifications and manipulations can be accomplished by methods known in the art such as site directed mutagenesis. The resulting modified molecules may then be tested for activity using in vitro or in vivo assays such as those described herein or any other suitable screening assay known in the art.

In some embodiments, compositions of the present disclosure may comprise one or more atoms that are isotopes. As used herein, the term "isotope" refers to a chemical element that has one or more additional neutrons. In some embodiments, compounds of the present disclosure may be deuterated. As used herein, the term "deuterate" refers to the process of replacing one or more hydrogen atoms in a substance with deuterium isotopes. Deuterium isotopes are isotopes of hydrogen. The nucleus of hydrogen contains one proton while deuterium nuclei contain both a proton and a neutron. The pharmaceutical compositions, biocircuits, biocircuit components, effector modules including their SREs or payloads of the present disclosure may be deuterated in order to change one or more physical property, such as stability, or to allow pharmaceutical compositions, biocircuits, biocircuit components, effector modules including their SREs or payloads to be used in diagnostic and/or experimental applications.

At the protein level, any of the biocircuit components may comprise one or more post-translational modifications (PTM). Such PTMs may occur intracellularly after administration of a protein-based biocircuit component or upon or after translation of a biocircuit component administered as a nucleic acid encoding said biocircuit component.

Post translational modifications (PTMs) of the present disclosure include, but are not limited to acetylation, phosphorylation, ubiquitination, carboxylation, deamidation, deamination, deacetylation, dihydroxylation, dephosphorylation, formylation, gamma-carboxyglutamation, glutathionylation, glycation, hydroxylation, methylation, nitration, sumoylation, N- or O-transglutamination, glycosylation and farnesylation.

Effector modules, including their SREs and payloads, may independently have 1, 2, 3, 4, 5, 6, 7, 8, 9, 10 or more PTMs which are the same or different.

Effector modules may be designed to include one or more structural or functional domain, repeat, or motif of a protein family. Such domains, repeats and motifs are categorized by protein family; and representative families are given in the EMBL-EBI database, located at www.ebi.ac.uk/.

In some embodiments, protein modifications engineered into the structure of the compositions of the disclosure to interfere with antigen processing and peptide loading such as glycosylation and PEGylation, may also be useful in the present disclosure. Compositions of the disclosure may also be engineered to include non-classical amino acid sidechains to design less immunogenic compositions.

The SRE may be, but is not limited to, a peptide, peptide complex, peptide-protein complex, protein, fusion protein, protein complex, protein-protein complex. The SRE may include one or more regions derived from any natural or mutated protein, or antibody. In this aspect, the SRE is an element, when responding to a stimulus, can tune intracellular localization, intramolecular activation, and/or degradation of payloads.

In some embodiments, effector modules of the present disclosure may comprise additional features that facilitate the expression and regulation of the effector module, such as one or more signal sequences (SSs), one or more cleavage and/or processing sites, one or more targeting and/or penetrating peptides, one or more tags, and/or one or more linkers. Additionally, effector modules of the present disclosure may further comprise other regulatory moieties such as inducible promoters, enhancer sequences, microRNA sites, and/or microRNA targeting sites. Each aspect or tuned modality may bring to the effector module or biocircuit a differentially tuned feature. For example, an SRE may represent a destabilizing domain, while mutations in the protein payload may alter its cleavage sites or dimerization properties or half-life and the inclusion of one or more microRNA or microRNA binding site may impart cellular detargeting or trafficking features. Consequently, the present disclosure embraces biocircuits which are multifactorial in their tenability. Such biocircuits may be engineered to contain one, two, three, four or more tuned features.

In some embodiments, the payload may be a fusion protein comprising any of the immunotherapeutic agents described and ubiquitin. Within the fusion protein, the ubiquitin may be positioned at the N terminus and the immunotherapeutic agent may be positioned at the C terminus. In one aspect, the immunotherapeutic agent may itself be a fusion protein and the ubiquitin may be located in between the proteins that are fused. The payloads may include a single ubiquitin protein or a chain of ubiquitin proteins. The ubiquitin protein may be linked to the immunotherapeutic agent through a single amino acid. The selection of the single amino acid may depend on the desired half-life of the fusion protein. In one embodiment, the immunotherapeutic agent may be IL12.

Polynucleotides

Biocircuit components including effector modules, their SREs and payloads, may be nucleic acid-based. The term "nucleic acid," in its broadest sense, includes any compound and/or substance that comprise a polymer of nucleotides, e.g., linked nucleosides. These polymers are often referred to as polynucleotides. Exemplary nucleic acids or polynucleotides of the disclosure include, but are not limited to, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization) or hybrids thereof.

In some embodiments, the nucleic acid molecule is a messenger RNA (mRNA). As used herein, the term "messenger RNA" (mRNA) refers to any polynucleotide which encodes a polypeptide of interest and which is capable of being translated to produce the encoded polypeptide of interest in vitro, in vivo, in situ or ex vivo. Polynucleotides of the disclosure may be mRNA or any nucleic acid molecule and may or may not be chemically modified.

In some embodiments, polynucleotides of the present disclosure may harbor 5'UTR sequences which play a role in translation initiation. 5'UTR sequences may include features such as Kozak sequences which are commonly known to be involved in the process by which the ribosome initiates translation of genes, Kozak sequences have the consensus XCCR(A/G) CCAUG, where R is a purine (adenine or guanine) three bases upstream of the start codon (AUG) and X is any nucleotide. In one embodiment, the Kozak sequence is ACCGCC. By engineering the features that are typically found in abundantly expressed genes of target cells or tissues, the stability and protein production of the polynucleotides of the disclosure can be enhanced.

Further provided are polynucleotides, which may contain an internal ribosome entry site (IRES) which play an important role in initiating protein synthesis in the absence of 5' cap structure in the polynucleotide. An IRES may act as the sole ribosome binding site, or may serve as one of the multiple binding sites. Polynucleotides of the disclosure containing more than one functional ribosome binding site may encode several peptides or polypeptides that are translated independently by the ribosomes giving rise to bicistronic and/or multicistronic nucleic acid molecules.

In one embodiment, polynucleotides of the present disclosure may encode variant polypeptides which have a certain identity with a reference polypeptide sequence. As used herein, a "reference polypeptide sequence" refers to a starting polypeptide sequence. Reference sequences may be wild type sequences or any sequence to which reference is made in the design of another sequence.

The term "identity" as known in the art, refers to a relationship between two or more sequences, as determined by comparing the sequences. In the art, identity also means the degree of sequence relatedness between sequences, as determined by the number of matches between strings of two or more residues (amino acid or nucleic acid). Identity measures the percent of identical matches between two or more sequences with gap alignments (if any) addressed by a particular mathematical model or computer program (i.e., "algorithms"). Identity of related sequences can be readily calculated by known methods.

In some embodiments, the variant sequence may have the same or a similar activity as the reference sequence. Alternatively, the variant may have an altered activity (e.g., increased or decreased) relative to a reference sequence. Generally, variants of a particular polynucleotide or polypeptide of the disclosure will have at least about 40%, 45%, 50%, 55%, 60%, 65%, 70%, 75%, 80%, 85%, 90%, 91%, 92%, 93%, 94%, 95%, 96%, 97%, 98%, 99% but less than 100% sequence identity to that particular reference polynucleotide or polypeptide as determined by sequence alignment programs and parameters described herein and known to those skilled in the art. Such tools for alignment include those of the BLAST suite (Stephen F. Altschul, Thomas L. Madden, Alejandro A. Schäffer, Jinghui Zhang, Zheng Zhang, Webb Miller, and David J. Lipman (1997), "Gapped BLAST and PSI-BLAST: a new generation of protein database search programs", Nucleic Acids Res. 25:3389-3402.)

In some embodiments, the polynucleotides may comprise two or more effector module component sequences which are in a pattern such as ABABAB or AABBAABBAABB or ABCABCABC or variants thereof repeated once, twice, or more than three times. In these patterns, each letter, A, B, or C represent a different effector module component.

In yet another embodiment, the polynucleotides may comprise two or more effector module component sequences with each component having one or more sequences. As a non-limiting example, the sequences may be in a pattern such as ABABAB or AABBAABBAABB or ABCAB-CABC or variants thereof repeated once, twice, or more than three times in each of the regions. As another non-limiting example, the sequences may be in a pattern such as ABA-BAB or AABBAABBAABB or ABCABCABC or variants thereof repeated once, twice, or more than three times across the entire polynucleotide. In these patterns, each letter, A, B, or C represent a different sequence or component.

Codon Selection

In some embodiments, one or more codons of the polynucleotides of the present disclosure may be replaced with other codons encoding the native amino acid sequence to tune the expression of the SREs, through a process referred to as codon selection. Since mRNA codon, and tRNA anticodon pools tend to vary among organisms, cell types, sub cellular locations and over time, the codon selection described herein is a spatiotemporal (ST) codon selection.

In some embodiments of the disclosure, certain polynucleotide features may be codon optimized.

For example, a preferred region for codon optimization may be upstream (5') or downstream (3') to a region which encodes a polypeptide. These regions may be incorporated into the polynucleotide before and/or after codon optimization of the payload encoding region or open reading frame (ORF).

Spatiotemporal codon selection may impact the expression of the polynucleotides of the disclosure, since codon composition determines the rate of translation of the mRNA species and its stability. For example, tRNA anticodons to optimized codons are abundant, and thus translation may be enhanced. In contrast, tRNA anticodons to less common codons are fewer and thus translation may proceed at a slower rate. Presnyak et al. have shown that the stability of an mRNA species is dependent on the codon content, and higher stability and thus higher protein expression may be achieved by utilizing optimized codons (Presnyak et al. (2015) Cell 160, 1111-1124; the contents of which are incorporated herein by reference in their entirety). Thus, in some embodiments, ST codon selection may include the selection of optimized codons to enhance the expression of the SREs, effector modules and biocircuits of the disclosure. In other embodiments, spatiotemporal codon selection may involve the selection of codons that are less commonly used in the genes of the host cell to decrease the expression of the compositions of the disclosure. The ratio of optimized codons to codons less commonly used in the genes of the host cell may also be varied to tune expression.

In some embodiments, certain regions of the polynucleotide may be preferred for codon selection. For example, a preferred region for codon selection may be upstream (5') or downstream (3') to a region which encodes a polypeptide. These regions may be incorporated into the polynucleotide before and/or after codon selection of the payload encoding region or open reading frame (ORF).

The stop codon of the polynucleotides of the present disclosure may be modified to include sequences and motifs to alter the expression levels of the SREs, payloads and effector modules of the present disclosure. Such sequences may be incorporated to induce stop codon readthrough, wherein the stop codon may specify amino acids e.g. selenocysteine or pyrrolysine. In other instances, stop codons may be skipped altogether to resume translation through an alternate open reading frame. Stop codon read through may be utilized to tune the expression of components of the effector modules at a specific ratio (e.g. as dictated by the stop codon context). Examples of preferred stop codon motifs include UGAN, UAAN, and UAGN, where N is either C or U.

Suppression of termination occurs during translation of many viral mRNAs as a means of generating a second protein with extended carboxy terminus. In retroviruses, gag and pol genes are encoded by a single mRNA and separated by an amber termination codon UAG. Translational suppression of the amber codon allows synthesis of the gag pol precursor. Translation suppression is mediated by suppressor tRNAs that can recognize termination codons and insert a specific amino acid. In some embodiments, effector modules described herein may incorporate amber termination codons. Such codons may be used in lieu of or in addition to IRES and p2A sequences in bicistronic constructs. Stop codon read through may be combined with P2A to obtain low level expression of downstream gene (e.g. IL12). In some embodiments, the amber stop codons may be combined with tRNA expression or amino-acyl tRNA synthetase for further control. In one aspect, the payload may be a regulated tRNA synthetase.

Conjugates

It is contemplated by the present disclosure that the compositions of the present disclosure may be complexed, conjugated or combined with one or more homologous or heterologous molecules. As used herein, the term "homologous molecule" refers to a molecule which is similar in at least one of structure or function relative to a starting molecule while a "heterologous molecule" is one that differs in at least one of structure or function relative to a starting molecule. Structural homologs are therefore molecules which may be substantially structurally similar. In some embodiments, such homologs may be identical. Functional homologs are molecules which may be substantially functionally similar. In some embodiments, such homologs may be identical.

Pharmaceutical compositions, biocircuits, biocircuit components, effector modules including their SREs or payloads of the present disclosure may comprise conjugates. Such conjugates of the disclosure may include naturally occurring substances or ligands.

In some embodiments, conjugates may also include targeting groups. As used herein, the term "targeting group" refers to a functional group or moiety attached to an agent that facilitates localization of the agent to a desired region, tissue, cell and/or protein.

In some embodiments, targeting groups may be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Targeting groups may also comprise hormones and/or hormone receptors.

In some embodiments, targeting groups may be any ligand capable of targeting specific receptors.

In still other embodiments, pharmaceutical compositions, biocircuits, biocircuit components, effector modules including their SREs or payloads of the present disclosure may be covalently conjugated to cell penetrating polypeptides. In some embodiments, cell-penetrating peptides may also include signal sequences. In some embodiments, conjugates of the disclosure may be designed to have increased stability, increased cell transfection and/or altered biodistribution (e.g., targeted to specific tissues or cell types.)

In some embodiments, conjugating moieties may be added to pharmaceutical compositions, biocircuits, biocircuit components, effector modules including their SREs or payloads of the present disclosure such that they allow the attachment of detectable labels to targets for clearance. Such detectable labels include, but are not limited to biotin labels, ubiquitins, fluorescent molecules, human influenza hemagglutinin (HA), c-myc, histidine (His), flag, glutathione S-transferase (GST), V5 (a paramyxovirus of simian virus 5 epitope), biotin, avidin, streptavidin, horse radish peroxidase (HRP) and digoxigenin.

In some embodiments, pharmaceutical compositions, biocircuits, biocircuit components, effector modules including their SREs or payloads of the present disclosure may be combined with one another or other molecules in the treatment of diseases and/or conditions.

In one embodiment, the SRE or payload of the present disclosure may be a conditionally active biologic protein. A wild type protein may be used to generate a conditionally active biologic protein which are reversibly or irreversibly inactivated at the wild type normal physiological conditions as well as to such conditionally active biologic proteins and uses of such conditional active biologic proteins are provided.

Immunotherapeutic Agents

In some embodiments, payloads of the present disclosure may be immunotherapeutic agents that induce immune responses in an organism. The immunotherapeutic agent may be, but is not limited to, an antibody and fragments and variants thereof, a chimeric antigen receptor (CAR), a chimeric switch receptor, a cytokine, chemokine, a cytokine receptor, a chemokine receptor, a cytokine-cytokine receptor fusion polypeptide, or any agent that induces an immune response. In one embodiment, the immunotherapeutic agent induces an anti-cancer immune response in a cell, or in a subject.

Antibodies Used for Immunotherapy

In some embodiments, payloads of the present disclosure may be antibodies, fragments and variants thereof which are specific to tumor specific antigens (TSAs) and tumor associated antigens (TAAs). Antibodies circulate throughout the body until they find and attach to the TSA/TAA. Once attached, they recruit other parts of the immune system, increasing ADCC (antibody dependent cell-mediated cytotoxicity) and ADCP (antibody dependent cell-mediated phagocytosis) to destroy tumor cells. As used herein, the term "tumor specific antigen (TSA)" means an antigenic substance produced in tumor cells, which can trigger an anti-tumor immune response in a host organism. In one embodiment, a TSA may be a tumor neoantigen. The tumor antigen specific antibody mediates complement-dependent cytotoxic response against tumor cells expressing the same antigen.

In some embodiments, the tumor specific antigens (TSAs), tumor associated antigens (TAAs), pathogen associated antigens, or fragments thereof can be expressed as a peptide or as an intact protein or portion thereof. The intact protein or a portion thereof can be native or mutagenized. Antigens associated with cancers or virus-induced cancers as described herein are well-known in the art. Such a TSA or TAA may be previously associated with a cancer or may be identified by any method known in the art.

In one embodiment, the antigen is CD19, a B-cell surface protein expressed throughout B-cell development. CD19 is a well-known B cell surface molecule, which upon B cell receptor activation enhances B-cell antigen receptor induced signaling and expansion of B cell populations. CD19 is broadly expressed in both normal and neoplastic B cells. Malignancies derived from B cells such as chronic lymphocytic leukemia, acute lymphocytic leukemia and many non-Hodgkin lymphomas frequently retain CD19 expression. This near universal expression and specificity for a single cell lineage has made CD19 an attractive target for immunotherapies. Human CD19 has 14 exons wherein exon 1-4 encode the extracellular portion of the CD19, exon 5 encodes the transmembrane portion of CD19 and exons 6-14 encode the cytoplasmic tail.

In one embodiment, payloads of the present disclosure may be antibodies, fragments and variants thereof which are specific to CD19 antigen.

In some embodiments, the immunotherapeutic agent may be an antibody that is specifically immunoreactive to an antigen selected from a tumor specific antigen (TSA), a tumor associated antigen (TAA), or an antigenic epitope.

In one aspect, the antigen may be an antigenic epitope. In some embodiments, the antigenic epitope may be CD19.

A tumor specific antigen (TSA) may be a tumor neoantigen. A neoantigen is a mutated antigen that is only expressed by tumor cells because of genetic mutations or alterations in transcription which alter protein coding sequences, therefore creating novel, foreign antigens. The genetic changes result from genetic substitution, insertion, deletion or any other genetic changes of a native cognate protein (i.e. a molecule that is expressed in normal cells). In the context of CD19, neoantigens such as a transcript variant of CD lacking exon 2 or lacking exon 5-6 or both have been described (see International patent publication No. WO2016061368; the contents of which are incorporated herein by reference in their entirety). In some instances, antibodies of the disclosure may include CD19 antibodies, antibody fragments or variants that recognize CD19 neoantigens including the CD19 neoantigen lacking exon2. In one embodiment, the antibody or fragment thereof is immunologically specific to the CD19 encoded by exon 1, 3 and/or 4. In one example, the antibody or fragment thereof is specific to the epitope that bridges the portion of CD19 encoded by exon 1 and the portion of CD19 encoded by exon 3.

Chimeric Antigen Receptors (CARS)

In some embodiments, payloads of the present disclosure may be a chimeric antigen receptors (CARs) which when transduced into immune cells (e.g., T cells and NK cells), can re-direct the immune cells against the target (e.g., a tumor cell) which expresses a molecule recognized by the extracellular target moiety of the CAR.

As used herein, the term "chimeric antigen receptor (CAR)" refers to a synthetic receptor that mimics TCR on the surface of T cells. In general, a CAR is composed of an extracellular targeting domain, a transmembrane domain/region and an intracellular signaling/activation domain. In a standard CAR receptor, the components: the extracellular targeting domain, transmembrane domain and intracellular signaling/activation domain, are linearly constructed as a single fusion protein. The extracellular region comprises a targeting domain/moiety (e.g., a scFv) that recognizes a specific tumor antigen or other tumor cell-surface molecules. The intracellular region may contain a signaling domain of TCR complex (e.g., the signal region of CD3ζ), and/or one or more costimulatory signaling domains, such as those from CD28, 4-1BB (CD137) and OX-40 (CD134). For example, a "first-generation CAR" only has the CD3ζ signaling domain. In an effort to augment T-cell persistence and proliferation, costimulatory intracellular domains are added, giving rise to second generation CARs having a CD3ζ signal domain plus one costimulatory signaling domain, and third generation CARs having CD3ζ signal domain plus two or more costimulatory signaling domains. A CAR, when expressed by a T cell, endows the T cell with antigen specificity determined by the extracellular targeting moiety of the CAR. Recently, it is also desirable to add one or more elements such as homing and suicide genes to develop a more competent and safer architecture of CAR, so called the fourth-generation CAR.

In some embodiments, the immunotherapeutic agent of the effector module is a chimeric antigen receptor (CAR). The chimeric antigen may comprise an extracellular target moiety; a transmembrane domain; an intracellular signaling domain; and optionally, one or more co-stimulatory domains.

In some embodiments, the extracellular targeting domain is joined through the hinge (also called space domain or spacer) and transmembrane regions to an intracellular signaling domain. The hinge connects the extracellular targeting domain to the transmembrane domain which transverses the cell membrane and connects to the intracellular signaling domain. The hinge may need to be varied to optimize the potency of CAR transformed cells toward cancer cells due to the size of the target protein where the targeting moiety binds, and the size and affinity of the targeting domain itself. Upon recognition and binding of the targeting moiety to the target cell, the intracellular signaling domain leads to an activation signal to the CAR T cell, which is further amplified by the "second signal" from one or more intracellular costimulatory domains. The CAR T cell, once activated, can destroy the target cell.

In some embodiments, the CAR of the present disclosure may be split into two parts, each part is linked a dimerizing domain, such that an input that triggers the dimerization promotes assembly of the intact functional receptor.

In some embodiments, the CAR of the present disclosure may be designed as an inducible CAR.

According to the present disclosure, the payload of the present disclosure may be a first-generation CAR, or a second-generation CAR, or a third-generation CAR, or a fourth-generation CAR. In some embodiments, the payload of the present disclosure may be a full CAR construct composed of the extracellular domain, the hinge and transmembrane domain and the intracellular signaling region. In other embodiments, the payload of the present disclosure may be a component of the full CAR construct including an extracellular targeting moiety, a hinge region, a transmembrane domain, an intracellular signaling domain, one or more co-stimulatory domain, and other additional elements that improve CAR architecture and functionality including but not limited to a leader sequence, a homing element and a safety switch, or the combination of such components.

CARs regulated by biocircuits and compositions of the present disclosure are tunable and thereby offer several advantages. The reversible on-off switch mechanism allows management of acute toxicity caused by excessive CAR-T cell expansion. Pulsatile CAR expression using SREs of the present disclosure may be achieved by cycling ligand level. The ligand conferred regulation of the CAR may be effective in offsetting tumor escape induced by antigen loss, avoiding functional exhaustion caused by tonic signaling due to chronic antigen exposure and improving the persistence of CAR expressing cells in vivo.

In some embodiments, biocircuits and compositions of the disclosure may be utilized to down regulate CAR expression to limit on target on tissue toxicity caused by tumor lysis syndrome. Down regulating the expression of the CARs of the present disclosure following anti-tumor efficacy may prevent (1) On target off tumor toxicity caused by antigen expression in normal tissue, (2) antigen independent activation in vivo.

In one embodiment, selection of a CAR with a lower affinity may provide more T cell signaling and less toxicity.

Extracellular Targeting Domain/Moiety

In accordance with the disclosure, the extracellular target moiety of a CAR may be any agent that recognizes and binds to a given target molecule, for example, a neoantigen on tumor cells, with high specificity and affinity. The target moiety may be an antibody and variants thereof that specifically binds to a target molecule on tumor cells, or a peptide aptamer selected from a random sequence pool based on its ability to bind to the target molecule on tumor cells, or a variant or fragment thereof that can bind to the target molecule on tumor cells, or an antigen recognition domain from native T-cell receptor (TCR) (e.g. CD4 extracellular domain to recognize HIV infected cells), or exotic recognition components such as a linked cytokine that leads to recognition of target cells bearing the cytokine receptor, or a natural ligand of a receptor.

In some embodiments, the targeting domain of a CAR may be a Ig NAR, a Fab fragment, a Fab' fragment, a F(ab)'2 fragment, a F(ab)'3 fragment, Fv, a single chain variable fragment (scFv), a bis-scFv, a (scFv)2, a minibody, a diabody, a tribody, a tetrabody, a disulfide stabilized Fv protein (dsFv), a unibody, a nanobody, or an antigen binding region derived from an antibody that specifically recognizes a target molecule, for example a tumor specific antigen (TSA). In one embodiment, the targeting moiety is a scFv. The scFv domain, when it is expressed on the surface of a CAR T cell and subsequently binds to a target protein on a cancer cell, is able to maintain the CAR T cell in proximity to the cancer cell and to trigger the activation of the T cell. A scFv can be generated using routine recombinant DNA technology techniques and is discussed in the present disclosure.

In one embodiment, the targeting moiety of the CAR may recognize CD19. CD19 is a well-known B cell surface molecule, which upon B cell receptor activation enhances B-cell antigen receptor induced signaling and expansion of B cell populations. CD19 is broadly expressed in both normal and neoplastic B cells. Malignancies derived from B cells such as chronic lymphocytic leukemia, acute lymphocytic leukemia and many non-Hodgkin lymphomas frequently retain CD19 expression. This near universal expression and specificity for a single cell lineage has made CD19 an attractive target for immunotherapies. Human CD19 has 14 exons wherein exon 1-4 encode the extracellular portion of the CD19, exon 5 encodes the transmembrane portion of CD19 and exons 6-14 encode the cytoplasmic tail. In one embodiment, the targeting moiety may comprise scFvs derived from the variable regions of the FMC63 antibody. FMC63 is an IgG2a mouse monoclonal antibody clone specific to the CD19 antigen that reacts with CD19 antigen on cells of the B lineage. The epitope of CD19 recognized by the FMC63 antibody is in exon 2 (Sotillo et al (2015) Cancer Discov; 5(12):1282-95; the contents of which are incorporated by reference in their entirety). In some embodiments, the targeting moiety of the CAR may be derived from the variable regions of other CD19 monoclonal antibody clones including but not limited to 4G7, SJ25C1, CVID3/429, CVID3/155, HIB19, and J3-119.

In some embodiments, the targeting moiety of a CAR may recognize a tumor specific antigen (TSA), for example a cancer neoantigen that is only expressed by tumor cells because of genetic mutations or alterations in transcription which alter protein coding sequences, therefore creating novel, foreign antigens. The genetic changes result from genetic substitution, insertion, deletion or any other genetic changes of a native cognate protein (i.e. a molecule that is expressed in normal cells). In the context of CD19, TSAs may include a transcript variant of human CD19 lacking exon 2 or lacking exon 5-6 or both (see International patent publication No. WO2016061368; the contents of which are incorporated herein by reference in their entirety). Since FMC63 binding epitope is in exon 2, CD19 lacking exon 2 is not recognized by FMC63 antibody. Thus, in some embodiments, the targeting moiety of the CAR may be an FMC63-distinct scFV. As used herein "FMC63-distinct" refers, to an antibody, scFv or a fragment thereof that is immunologically specific and binds to an epitope of the CD19 antigen that is different or unlike the epitope of CD19 antigen that is bound by FMC63. In some instances, targeting moiety may recognize a CD19 antigen lacking exon2. In one embodiment, the targeting moiety recognizes a fragment of CD19 encoded by exon 1, 3 and/or 4. In one example, the targeting moiety recognizes the epitope that bridges the portion of CD19 encoded by exon 1 and the portion of CD19 encoded by exon 3.

In one aspect, the extracellular target moiety may be an scFv derived from an antibody. In one aspect, the scFv may specifically bind to a CD19 antigen.

Intracellular Signaling Domains

The intracellular domain of a CAR fusion polypeptide, after binding to its target molecule, transmits a signal to the immune effector cell, activating at least one of the normal effector functions of immune effector cells, including cytolytic activity (e.g., cytokine secretion) or helper activity. Therefore, the intracellular domain comprises an "intracellular signaling domain" of a T cell receptor (TCR).

In some aspects, the entire intracellular signaling domain can be employed. In other aspects, a truncated portion of the intracellular signaling domain may be used in place of the intact chain as long as it transduces the effector function signal.

In some embodiments, the intracellular signaling domain of the present disclosure may contain signaling motifs which are known as immunoreceptor tyrosine-based activation motifs (ITAMs). Examples of ITAM containing cytoplasmic signaling sequences include those derived from TCR CD3zeta, FcR gamma, FcR beta, CD3 gamma, CD3 delta, CD3 epsilon, CD5, CD22, CD79a, CD79b, and CD66d. In one example, the intracellular signaling domain is a CD3 zeta (CD3ζ) signaling domain.

In some embodiments, the intracellular region of the present disclosure further comprises one or more costimulatory signaling domains which provide additional signals to the immune effector cells. These costimulatory signaling domains, in combination with the signaling domain can further improve expansion, activation, memory, persistence, and tumor-eradicating efficiency of CAR engineered immune cells (e.g., CART cells). In some cases, the costimulatory signaling region contains 1, 2, 3, or 4 cytoplasmic domains of one or more intracellular signaling and/or costimulatory molecules. The costimulatory signaling domain may be the intracellular/cytoplasmic domain of a costimulatory molecule, including but not limited to CD2, CD7, CD27, CD28, 4-1BB (CD137), OX40 (CD134), CD30, CD40, ICOS (CD278), GITR (glucocorticoid-induced tumor necrosis factor receptor), LFA-1 (lymphocyte function-associated antigen-1), LIGHT, NKG2C, B7-H3. In one example, the costimulatory signaling domain is derived from the cytoplasmic domain of CD28. In another example, the costimulatory signaling domain is derived from the cytoplasmic domain of 4-1BB (CD137).

In some embodiments, T cells engineered with two or more CARs incorporating distinct co-stimulatory domains and regulated by distinct DD may be used to provide kinetic control of downstream signaling.

In some embodiments, the GITR co-stimulatory domains may be useful in the CAR described herein. In some embodiments, the GITR domains may be capable of inducing T cell effector function and activating T cells. In some aspects, GITR domains described herein may be able to suppress inhibitory T regulatory cells that block immune response. In some embodiments, GITR intracellular domain containing CAR T cells can decrease the production of cytokines, which may reduce the cytokine release syndrome.

Transmembrane Domains and Hinge Regions

In some embodiments, the CAR of the present disclosure may comprise a transmembrane domain. As used herein, the term "Transmembrane domain (TM)" refers broadly to an amino acid sequence of about 15 residues in length which spans the plasma membrane. More preferably, a transmembrane domain includes at least 20, 21, 22, 23, 24, 25, 26, 27, 28, 29, 30, 31, 32, 33, 34, 35, 36, 37, 38, 39, 40, 41, 42, 43, 44, or 45 amino acid residues and spans the plasma membrane. In some embodiments, the transmembrane domain of the present disclosure may be derived either from a natural or from a synthetic source. The transmembrane domain of a CAR may be derived from any naturally membrane-bound or transmembrane protein. For example, the transmembrane region may be derived from (i.e. comprise at least the transmembrane region(s) of) the alpha, beta or zeta chain of the T-cell receptor, CD3 epsilon, CD4, CD5, CD8, CD8α, CD9, CD16, CD22, CD33, CD28, CD37, CD45, CD64, CD80, CD86, CD134, CD137, CD152, or CD154.

Alternatively, the transmembrane domain of the present disclosure may be synthetic. In some aspects, the synthetic sequence may comprise predominantly hydrophobic residues such as leucine and valine.

In some embodiments, the transmembrane domain of the present disclosure may be selected from the group consisting of a CD8a transmembrane domain, a CD4 transmembrane domain, a CD 28 transmembrane domain, a CTLA-4 transmembrane domain, a PD-1 transmembrane domain, and a human IgG4 Fc region. As non-limiting examples, the transmembrane domain may be a CTLA-4 transmembrane domain comprising the amino acid sequences of SEQ ID NOs. 1-5 of International Patent Publication NO. WO2014/100385; and a PD-1 transmembrane domain comprising the amino acid sequences of SEQ ID NOs. 6-8 of International Patent Publication NO. WO2014100385; the contents of each of which are incorporated herein by reference in their entirety.

In some embodiments, the CAR of the present disclosure may comprise an optional hinge region (also called spacer). A hinge sequence is a short sequence of amino acids that facilitates flexibility of the extracellular targeting domain that moves the target binding domain away from the effector cell surface to enable proper cell/cell contact, target binding and effector cell activation (Patel et al., Gene Therapy, 1999; 6: 412-419). The hinge sequence may be positioned between the targeting moiety and the transmembrane domain. The hinge sequence can be any suitable sequence derived or obtained from any suitable molecule. The hinge sequence may be derived from all or part of an immunoglobulin (e.g., IgG1, IgG2, IgG3, IgG4) hinge region, i.e., the sequence that falls between the CHI and CH2 domains of an immunoglobulin, e.g., an IgG4 Fc hinge, the extracellular regions of type 1 membrane proteins such as CD8a CD4, CD28 and CD7, which may be a wild type sequence or a derivative. Some hinge regions include an immunoglobulin CH3 domain or both a CH3 domain and a CH2 domain. In certain embodiments, the hinge region may be modified from an IgG1, IgG2, IgG3, or IgG4 that includes one or more amino acid residues, for example, 1, 2, 3, 4 or 5 residues, substituted with an amino acid residue different from that present in an unmodified hinge.

In some embodiments, the CAR of the present disclosure may comprise one or more linkers between any of the domains of the CAR. The linker may be between 1-30 amino acids long. In this regard, the linker may be 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 amino acids in length. In other embodiments, the linker may be flexible.

In some embodiments, the components including the targeting moiety, transmembrane domain and intracellular signaling domains of the present disclosure may be constructed in a single fusion polypeptide. The fusion polypeptide may be the payload of an effector module of the disclosure. In some embodiments, more than one CAR fusion polypeptides may be included in an effector module, for example, two, three or more CARs may be included in the effector module under the control of a single SRE (e.g., a DD). Representative effector modules comprising the CAR payload are illustrated in FIGS. 2-6 in International Publication No. WO2017/180587, the contents of which are herein incorporated by reference in their entirety.

In one embodiment of the present disclosure, the payload of the disclosure is a CD19 specific CAR targeting different B cell. In the context of the disclosure, an effector module may comprise a hDHFR DD, ecDHFR DD, or FKBP DD operably linked to a CD19 CAR fusion construct. In some instances, the promoter utilized to drive the expression of the effector module in the vector may be a CMV promoter, an EF1a promoter or a PGK promoter. The efficiency of the promoter in driving the expression of the same construct may be compared. For example, two constructs that differ only by their promoter, CMV, EF1a, or PGK promoter may be compared.

In some embodiments, the constructs described herein may comprise two or more payloads and are herein referred to as "tandem constructs". For example, the CD19 CAR IL12 tandem construct may comprise the both the CD19 CAR and the IL12 payloads operably linked to each. One or more payloads in a tandem construct may further be appended to an SRE to generate the biocircuits of the disclosure.

In one embodiment, the CAR construct comprises a CD19 scFV (e.g., CAT13.1E10 or FMC63), a CD8α spacer or transmembrane domain, and a 4-1BB and CD3t endodomain. These constructs with CAT13.1E10 may have increased proliferation after stimulation in vitro, increased cytotoxicity against the CD19+ targets, and increased effector and target interactions as compared to constructs with FMC63.

In some embodiments, the payload of the disclosure may be any of the co-stimulatory molecules and/or intracellular domains described herein. In some embodiments, one or more co-stimulatory molecules, each under the control of different SRE may be used in the present disclosure. SRE regulated co-stimulatory molecules may also be expressed in conjunction with a first-generation CAR, a second generation CAR, a third generation CAR, a fourth generation, or any other CAR design described herein.

Tandem CAR (TanCAR)

In some embodiments, the tandem constructs described herein may be a tandem chimeric antigen receptor (TanCAR) which is able to target two, three, four, or more tumor specific antigens. In some aspects, The CAR is a bispecific TanCAR including two targeting domains which recognize two different TSAs on tumor cells. The bispecific CAR may be further defined as comprising an extracellular region comprising a targeting domain (e.g., an antigen recognition domain) specific for a first tumor antigen and a targeting domain (e.g., an antigen recognition domain) specific for a second tumor antigen. In other aspects, the CAR is a multispecific TanCAR that includes three or more targeting domains configured in a tandem arrangement. The space between the targeting domains in the TanCAR may be between about 5 and about 30 amino acids in length, for example, 6, 7, 8, 9, 10, 11, 12, 13, 14, 15, 16, 17, 18, 19, 20, 21, 22, 23, 24, 25, 26, 27, 28, 29 and 30 amino acids.

Split CAR

In some embodiments, the components including the targeting moiety, transmembrane domain and intracellular signaling domains of the present disclosure may be split into two or more parts such that it is dependent on multiple inputs that promote assembly of the intact functional receptor. In one embodiment, the split synthetic CAR system can be constructed in which the assembly of an activated CAR receptor is dependent on the binding of a ligand to the SRE (e.g. a small molecule) and a specific antigen to the targeting moiety. As a non-limiting example, the split CAR consists of two parts that assemble in a small molecule-dependent manner; one part of the receptor features an extracellular antigen binding domain (e.g. scFv) and the other part has the intracellular signaling domains, such as the CD3ζ intracellular domain.

In other aspects, the split parts of the CAR system can be further modified to increase signal. In one example, the second part of cytoplasmic fragment may be anchored to the plasma membrane by incorporating a transmembrane domain (e.g., CD8α transmembrane domain) to the construct. An additional extracellular domain may also be added to the second part of the CAR system, for instance an extracellular domain that mediates homo-dimerization. These modifications may increase receptor output activity, i.e., T cell activation.

In some aspects, the two parts of the split CAR system contain heterodimerization domains that conditionally interact upon binding of a heterodimerizing small molecule. As such, the receptor components are assembled in the presence of the small molecule, to form an intact system which can then be activated by antigen engagement. Any known heterodimerizing components can be incorporated into a split CAR system. The dual regulation using inducible assembly (e.g., ligand dependent dimerization) and degradation (e.g., destabilizing domain induced CAR degradation) of the split CAR system may provide more flexibility to control the activity of the CAR modified T cells.

Switchable CAR

In some embodiments, the CAR of the disclosure may be a switchable CAR. In this CAR design, a system is directly integrated in the hinge domain that separate the scFv domain from the cell membrane domain in the CAR. Such system is possible to split or combine different key functions of a CAR such as activation and co-stimulation within different chains of a receptor complex, mimicking the complexity of the TCR native architecture. This integrated system can switch the scFv and antigen interaction between on/off states controlled by the absence/presence of the stimulus.

Reversible CAR

In other embodiments, the CAR of the disclosure may be a reversible CAR system. In this CAR architecture, a LID domain (ligand-induced degradation) is incorporated into the CAR system. The CAR can be temporarily downregulated by adding a ligand of the LID domain. The combination of LID and DD mediated regulation provides tunable control of continuingly activated CAR T cells, thereby reducing CAR mediated tissue toxicity.

Activation-Conditional CAR

In some embodiments, payloads of the disclosure may be an activation-conditional chimeric antigen receptor, which is only expressed in an activated immune cell. The expression of the CAR may be coupled to activation conditional control region which refers to one or more nucleic acid sequences that induce the transcription and/or expression of a sequence e.g. a CAR under its control. Such activation conditional control regions may be promoters of genes that are upregulated during the activation of the immune effector cell e.g. IL2 promoter or NFAT binding sites. In some embodiments, activation of the immune cell may be achieved by a constitutively expressed CAR (International Publication NO. WO2016126608; the contents of which are incorporated herein by reference in their entirety).

Cytokines, Chemokines and Other Soluble Factors

In accordance with the present disclosure, CARs of the present disclosure may be utilized along with other payloads of the present disclosure which may be cytokines, chemokines, growth factors, and soluble proteins produced by immune cells, cancer cells and other cell types, which act as chemical communicators between cells and tissues within the body. These proteins mediate a wide range of physiological functions, from effects on cell growth, differentiation, migration and survival, to a number of effector activities. For example, activated T cells produce a variety of cytokines for cytotoxic function to eliminate tumor cells.

In some embodiments, payloads of the present disclosure may be cytokines, and fragments, variants, analogs and derivatives thereof, including but not limited to interleukins, tumor necrosis factors (TNFs), interferons (IFNs), TGF beta and chemokines. It is understood in the art that certain gene and/or protein nomenclature for the same gene or protein may be inclusive or exclusive of punctuation such as a dash "-" or symbolic such as Greek letters. Whether these are included or excluded herein, the meaning is not meant to be changed as would be understood by one of skill in the art. For example, IL2, IL2 and IL-2 refer to the same interleukin. Likewise, TNFalpha, TNFα, TNF-alpha, TNF-α, TNF alpha and TNF α all refer to the same protein. In some embodiments, payloads of the present disclosure may be cytokines that stimulate immune responses. In other embodiments, payloads of the disclosure may be antagonists of cytokines that negatively impact anti-cancer immune responses.

In some embodiments, payloads of the present disclosure may be cytokine receptors, recombinant receptors, variants, analogs and derivatives thereof; or signal components of cytokines.

In some embodiments, cytokines of the present disclosure may be utilized to improve expansion, survival, persistence, and potency of immune cells such as CD8+ TEM, natural killer cells and tumor infiltrating lymphocytes (TIL) cells used for immunotherapy. In other embodiments, T cells engineered with two or more DD regulated cytokines are utilized to provide kinetic control of T cell activation and tumor microenvironment remodeling. In one aspect, the present disclosure provides biocircuits and compositions to minimize toxicity related to cytokine therapy. Despite its success in mitigating tumor burden, systemic cytokine therapy often results in the development of severe dose limiting side effects. Two factors contribute to the observed toxicity (a) Pleiotropism, wherein cytokines affect different cells types and sometimes produce opposing effects on the same cells depending on the context (b) Cytokines have short serum half-life and thus need to be administered at high doses to achieve therapeutic effects, which exacerbates the pleiotropic effects. In one aspect, cytokines of the present disclosure may be utilized to modulate cytokine expression in the event of adverse effects. In some embodiments, cytokines of the present disclosure may be designed to have prolonged life span or enhanced specificity to minimize toxicity.

In some embodiments, the payload of the present disclosure may be an interleukin (IL) cytokine. Interleukins (ILs) are a class of glycoproteins produced by leukocytes for regulating immune responses. As used herein, the term "interleukin (IL)" refers to an interleukin polypeptide from any species or source and includes the full-length protein as well as fragments or portions of the protein. In one embodiment, the payload of the disclosure may comprise IL12.

In one aspect, the effector module of the disclosure may be a DD-IL12 fusion polypeptide. This regulatable DD-IL12 fusion polypeptide may be directly used as an immunotherapeutic agent or be transduced into an immune effector cell (T cells and TIL cells) to generate modified T cells with greater in vivo expansion and survival capabilities for adoptive cell transfer.

In one embodiment, regulated cytokines may enable CAR-T in solid tumors to overcome stromal barriers by improving tumor homing, reducing immunosuppression, and reducing tumor promoting conditions. In one embodiment, regulated cytokines may enable CAR-T in solid tumors to overcome Antigen negative escape by promoting epitope spreading, antigen presenting cell trafficking, activation and licensing. In one embodiment, regulated cytokines may enable CAR-T in solid tumors to overcome Antigen positive escape by improving expansion, increasing persistence, reducing exhaustion of T cells. In one embodiment, regulated cytokines enable local, on demand production of cytokines can safely improve efficacy. In one embodiment, regulated cytokines enable pulsatile production that can reduce feedback inhibition of cytokine signaling. In one embodiment, regulated cytokines can reduce senescence or exhaustion. In one embodiment, regulated cytokines enable on demand expression in patient which may reduce any effect of cytokine on cell phenotype during product manufacturing.

Exemplary Effector Module Constructs

Biocircuits of the present disclosure may comprise at least one effector module. The effector module may comprise at least one SRE which may be operably linked to at least one payload of interest. Additionally, the effector module may comprise additional features including, but not limited to, signal sequences, linker, spacers, tags, flags, cleavage sites, and IRES. Any of the exemplary SREs (e.g., DDs), payloads of interest, signal sequences, linker, spacers, tags, flags, cleavage sites, and IRES taught herein or known in the art may be combined to create the effector modules of the present disclosure.

In one embodiment, the effector module comprises a payload of interest. The payload of interest may be a wild-type sequence, a fragment of a wild-type sequence and/or comprise one or more mutations. Non-limiting examples of the payload of interest are shown in Table 4. In Table 4, "WT" means wild-type.

TABLE 4

Payloads of Interest

| Description | Amino Acid SEQ ID | Nucleic Acid SEQ ID |
|---|---|---|
| Interleukin-12 subunit beta (p40) (WT) | 434 | 435 |
| Interleukin-12 subunit beta (p40) (23-328 of WT) | 436 | 437-445 |
| Interleukin-12 subunit beta (p40) (K217N) | 446 | 447 |
| Interleukin-12 subunit alpha (p35) (WT) | 448 | 449-450 |
| Interleukin-12 subunit alpha (p35) (57-253 of WT) | 451 | 452-463, 486 |
| Interleukin-12 subunit alpha (p35) (61-253 of WT) | 464 | |

In one embodiment, the effector module produces regulated interleukin-12 (IL12). The effector module may include or be derived from any of the IL12-related sequences in Table 4. For example, the effector module may include a p40 and p35-derived payload. In one embodiment, at least one payload in the effector module is a p40 wild-type sequence (SEQ ID NO: 434, encoded by SEQ ID NO: 435). In one embodiment, at least one payload in the effector module is a region of the p40 wild-type sequence. As a non-limiting example, at least one payload in the effector module is amino acid 23-328 of the p40 wild-type sequence (SEQ ID NO: 436, encoded by SEQ ID NO: 437-445). In one embodiment, at least one payload in the effector module is a p35 wild-type sequence (SEQ ID NO: 448, encoded by SEQ ID NO: 449-450). In one embodiment, at least one payload in the effector module is a region of the p35 wild-type sequence. As a non-limiting example, at least one payload in the effector module is amino acid 57-253 of the p35 wild-type sequence (SEQ ID NO: 451, encoded by SEQ ID NO: 452-463). As a non-limiting example, at least one payload in the effector module is amino acid 61-253 of the p35 wild-type sequence (SEQ ID NO: 464). In one embodiment, at least one payload in the effector module is a region of p40 and/or p35 which does not include the transmembrane domain and/or cytoplasmic domain. The effector module may include a payload of a transmembrane domain and/or cytoplasmic domain from another parent protein as well as the p40 and/or p35 payload. In one embodiment, at least one payload in the effector module includes at least one mutation as compared to the wild-type sequence.

The biocircuits and/or effector modules of the present disclosure may be monocistronic or multicistronic meaning one (monocistronic) or more than one (multicistronic) message (e.g., payload of interest) is produced. If two messages are produced, the biocircuit or effector module is considered bicistronic.

In one embodiment, at least effector module of the present disclosure is monocistronic.

In one embodiment, at least effector module of the present disclosure is multicistronic.

In one embodiment, at least effector module of the present disclosure is bicistronic.

In one embodiment, the biocircuit of the present disclosure is monocistronic.

In one embodiment, the biocircuit of the present disclosure is multicistronic.

In one embodiment, the biocircuit of the present disclosure is bicistronic.

IL12 Effector Modules

In one embodiment, the payload of the disclosure may comprise IL12. IL12 is a heterodimeric protein of two subunits (p35, p40) that is secreted by antigen presenting cells, such as macrophages and dendritic cells. Expression of IL12 requires the simultaneous expression of the two subunits to produce a biologically active heterodimer. In some embodiments, payloads of the disclosure may be p35 subunit or the p40 subunit. IL12 is type 1 cytokine that acts on natural killer (NK) cells, macrophages, CD8+ Cytotoxic T cells, and CD4+ T helper cells through STAT4 pathway to induce IFN-γ production in these effector immune cells (reviewed by Trinchieri G, Nat Rev Immunol. 2003; 3(2): 133-146). IL12 can promote the cytotoxic activity of NK cells and CD8+ T cells, therefore has anti-tumor function as well as promote T cell persistence in vivo. Intravenous injection of recombinant IL12 exhibited modest clinical efficacy in a handful of patients with advanced melanoma and renal cell carcinoma (Gollob et al., Clin. Cancer Res. 2000; 6(5):1678-1692). IL12 has been used as an adjuvant to enhance cytotoxic immunity using a melanoma antigen vaccine, or using peptide pulsed peripheral blood mononuclear cells; and to promote NK cell activity in breast cancer with trastuzumab treatment. Local delivery of IL12 to the tumor microenvironment promotes tumor regression in several tumor models. These studies all indicate that locally increased IL12 level can promote anti-tumor immunity. One major obstacle of systemic or local administration of recombinant IL12 protein, or through oncolytic viral vectors is the severe side effects when IL12 is presented at high level. Developing a system that tightly controls IL12 level may provide a safe use of IL12 in cancer treatment. A regulatable IL12 composition may also prevent negative feedback loops, thereby enhancing T cell effector functions.

In one aspect, the effector module of the disclosure may be a DD-IL12 fusion polypeptide. This regulatable DD-IL12 fusion polypeptide may be directly used as an immunotherapeutic agent or be transduced into an immune effector cell (T cells and TIL cells) to generate modified T cells with greater in vivo expansion and survival capabilities for adoptive cell transfer. The need for harsh preconditioning regimens in current adoptive cell therapies may be minimized using regulated IL12 DD-IL12 may be utilized to modify tumor microenvironment and increase persistence in solid tumors that are currently refractory to tumor antigen targeted therapy. In some embodiments, CAR expressing T cells may be armored with DD regulated IL12 to relieve immunosuppression without systemic toxicity. In some embodiments, the payloads of the present disclosure may be used to enhance cell therapies with performance optimized for challenging tumor microenvironments.

In some embodiments, the IL12 may be a Flexi IL12, wherein both p35 and p40 subunits, are encoded by a single cDNA that produces a single chain polypeptide. The single chain polypeptide may be generated by placing p35 subunit at the N terminus or the c terminus of the single chain polypeptide. Similarly, the p40 subunit may be at the N terminus or C terminus of the single chain polypeptide.

In some embodiments, the IL12 expression may be tuned to generate a Th1 response in vivo. CD4+ T cells differentiate into effector Th1 cells that are involved in Th1 response. Th1 cells produce IL2 and interferon gamma, which are involved in cell mediated responses. In some embodiments, compositions of the disclosure may be tuned to achieve low basal expression in the absence of the stimulus and IL12 levels sufficient to generate Th1 response. In some embodiments, compositions of the disclosure may be tuned to achieve low basal expression in the absence of stimulus and then expression is induced at least 1×, 2×, 3×, 4×, 5×, 6×, 7×, 8×, 9×, 10×, or more than 10× upon the addition of the drug.

The format of the IL12 constructs utilized as payload of the present disclosure may be optimized. In one embodiment, the payload of the disclosure may be a bicistronic IL12 containing p40 and p35 subunits separated by an internal ribosome entry site or a cleavage site such as P2A or Furin to allow independent expression of both subunits from a single vector. This results in a configuration of secreted IL12 that is more akin to the naturally occurring IL12 than the flexi IL12 construct, the payload of the disclosure may be the p40 subunit of the IL12. DD regulated p40 may be co-expressed with constitutive p35 construct to generate "regulatable IL12" expression. Alternatively, the DD regulated p40 may heterodimerize with the endogenous p35. p40 has been shown to stabilize p35 expression and stimulate the export of p35 (Jalah R, et al. (2013). Journal of Biol. Chem. 288, 6763-6776 (the contents of which are incorporated by reference in its entirety).

In some embodiments, modified forms of IL12 may be utilized as the payload. These modified forms of IL12 may be engineered to have shortened half-life in vivo compared to the non-modified form of especially when used in combination with tunable systems described herein.

Human flexi IL12 has a reported half-life of 5-19 hours which, when administered as a therapeutic compound, can result in systemic cytotoxicity (Car et al. (1999) The Toxicology of Interleukin-12: A Review" Toxicologic Path. 27 A, 58-63; Robertson et al. (1999) "Immunological Effects of Interleukin 12 Administered by Bolus Intravenous Injection to Patients with Cancer" Clin. Cancer Res. 5:9-16; Atkins et al. (1997) "Phase I Evaluation of Intravenous Recombinant Human Interleukin 12 in Patients with Advance Malignancies" Clin. Cancer Res. 3:409-417). The ligand inducible control of IL12 can regulate production in a dose dependent fashion, the time from cessation of ligand dosing to cessation of protein synthesis and IL12 clearance may be insufficient to prevent toxic accumulation of IL12 in plasma.

In one embodiment, the modified form of IL12 utilized as the payload may be a Topo-sc IL12 which have the configuration as follows from N to C terminus (i) a first IL12 p40 domain (p40N), (ii) an optional first peptide linker, (iii) an IL12 p35 domain, (iv) an optional second peptide linker, and (v) a second IL12 p40 domain (p40C). In one embodiment, modified topo-sc-IL12 polypeptides exhibit increased susceptibility to proteolysis. Topo-sc IL12 is described in International Patent Publication No. WO2016048903; the contents of which are incorporated herein by reference in its entirety. Increased susceptibility of IL12 to proteolysis may also be achieved by engineering mutations within p40 and/or p35. Such mutations are described in International Patent Publications WO2017062953 and WO2016048903 (the contents of each of which are incorporated by reference in their entirety).

IL12 polypeptide may also be modified (e.g. genetically, synthetically, or recombinantly engineered) to increase susceptibility to proteinases to reduce the biologically active half-life of the IL12 complex, compared to a corresponding IL12 lacking proteinases susceptibility. Proteinase susceptible forms of IL12 are described in International Patent Publication No. WO2017062953; the contents of which are incorporated by reference in its entirety.

In some embodiments, the pharmacokinetic/pharmacodynamic measurements of IL12 in vivo may be assessed by measuring serum IL12 levels and/or downstream mediators of IL12 such as IL16, IL6 and IL10.

Membrane Associated IL12 Effector Modules

In some embodiments, the payload may be IL12 that is membrane bound. IL12 may be bound to the membrane by a transmembrane domain. The transmembrane domain may also include an optional hinge domain. In some aspects, the effector modules comprising membrane bound IL12 as the payload may be designed such that the DD remains intracellular whereas the IL12 molecule is extracellular and tethered to the cell by the transmembrane domain. In one embodiment, the membrane associated IL12 may be utilized to reduce systemic toxicity observed with soluble IL12. The membrane bound IL12 may be shed or cleaved from the cell surface by the action of proteases.

As used herein, the term "transmembrane domain (TM)" refers broadly to an amino acid sequence of about 15 residues in length which spans the plasma membrane. More preferably, a transmembrane domain includes at least 20, 21, 22, 23, 24, 25, 26, 27, 28, 29, 30, 31, 32, 33, 34, 35, 36, 37, 38, 39, 40, 41, 42, 43, 44, or 45 amino acid residues and spans the plasma membrane. In some embodiments, the transmembrane domain of the present disclosure may be derived either from a natural or from a synthetic source. The transmembrane domain may be derived from any naturally membrane-bound or transmembrane protein.

Alternatively, the transmembrane domain of the present disclosure may be synthetic. In some aspects, the synthetic sequence may comprise predominantly hydrophobic residues such as leucine and valine.

In some aspects, transmembrane and/or hinge domains that are resistant to the activity of proteases may be selected. Hinge domains that are resistant to proteases include but are not limited to hinge and/or transmembrane domains derived from B7.1 (also referred to as CD80), FCgr2b, IgG1. In some embodiments, the hinge and transmembrane domain may be derived from the C2 domain of B7.1 In one embodiment, the hinge and transmembrane domain may be derived from the CHD2-CH3 domain of IgG1. Membrane bound IL12 constructs may optionally include a cytoplasmic tail. As a non-limiting example the tail may be derived from B7.1 or CD8. In one aspect, the transmembrane domains may be derived from non-human species such as but not limited to *Mus musculus*. Transmembrane and hinge domains useful in the effector modules may be the complete domain or a region or portion of the domain.

In some embodiments, membrane associated IL12 effector modules described herein may include transmembrane domain derived from B7.1, and/or PDGFR. In some aspects, the payload IL12 may be tethered to the membrane using a Glycosylphosphatidylinositol (GPI) anchor (Bozeman E N, et al. (2013) Vaccine. 7; 31(20):2449-56; the contents of which are incorporated by reference in its entirety). In some embodiments, membrane associated IL12 effector modules may include immunoglobulin kappa chain signal peptide, an HA tag, Flexi IL12, B7.1 transmembrane domain and a B7.1 cytoplasmic tail. A linker may optionally be included between any two components of the membrane associated IL12 effector modules.

Any of the membrane associated IL12 constructs described in the following may be utilized in the effector modules described in the present disclosure including International Patent publication WO2017192924, Chakrabarti et al. 2004, Plasmids encoding membrane-bound IL-4 or IL-12 strongly co-stimulate DNA vaccination against carcinoembryonic antigen (CEA) Vaccine. 22. 1199-205; Tao et al. 2005 Membrane-bound interleukin 12 induced stronger antitumor immunity than soluble interleukin 12 without inducing circulating interferon gamma. Cancer Res (65) (9 Supplement) 1410; and Pan et al. 2012. Cancer immunotherapy using a membrane-bound interleukin-12 with B7-1 transmembrane and cytoplasmic domains Mol. Ther. 2012 May; 20(5):927-37; the contents of each of which are incorporated by reference in their entirety. Membrane associated IL12 effector modules may include miR binding sites designed to modulate the half-life of IL12 as described in the International Patent Publication WO2018213731 (the contents of which are incorporated by reference in their entirety). In one embodiment, tunability of IL12 effector modules may be achieved by incorporation of tunable domains described in the International Patent Publications WO2016048903 and WO2017062953 (the contents of which are incorporated by reference in their entirety).

In one embodiment, membrane associated IL12 effector modules may include a cleavage site or the recognition sequence of a proteolytic enzyme. Inclusion of such cleavage sites may allow for the release of the IL12 from the cell surface. Cleavage sites that are the targeted by proteases known to be present in the tumor microenvironment e.g. MMP7, ADAM10 and ADAM17 may be selected. In some embodiments, such cleavage sites may be derived from FasL and or TNF. Any of the cleavage sites described in the following publications may be used in the effector modules described herein: Schneider, P. et al. Conversion of Membrane-bound Fas(CD95) Ligand to Its Soluble Form Is Associated with Downregulation of Its Proapoptotic Activity and Loss of Liver Toxicity. J. Exp. Med. 187, 1205-1213 (1998); and Schulte, M. et al. ADAM10 regulates FasL cell surface expression and modulates FasL-induced cytotoxicity and activation-induced cell death. Cell Death Differ. 14, 1040-1049 (2007) (the contents of each of which are incorporated by reference in their entirety).

Membrane associated IL12 constructs either alone or in tandem with CD19 CAR are provided in Table 5. Any of the DD described herein may be combined with the construct components in Table 5 to prepare regulated membrane IL12 constructs.

TABLE 5

Membrane-associated IL12 constructs and its components

| Identifier | Description | AA SEQ ID or Sequence | NA SEQ ID or Sequence |
|---|---|---|---|
| SS-154 (Nucleic acid SS-143; SS-144) | CD8a (or CD8α) leader; T-cell surface glycoprotein CD8 alpha chain | 412 | 413; 414 |
| SS-488 (Nucleic acid: SS-494) | IL12B leader | 415 | 416 |
| SS-912 (Nucleic acid: SS-913; SS-914) | CD8A leader (no Met) | 629 | 630; 631 |
| SS-915 (Nucleic acid: SS-916) | IL12B leader (no Met) | 632 | 633 |
| SCFV-201 (Nucleic acid: SCFV-976) | CD19 scFV | 425 | 426 |
| DOM-33 (Nucleic acid: DOM-34; DOM-265) | Hinge and TM Domains | 427 | 428; 429 |

TABLE 5-continued

Membrane-associated IL12 constructs and its components

| Identifier | Description | AA SEQ ID or Sequence | NA SEQ ID or Sequence |
|---|---|---|---|
| DOM-254 (Nucleic acid: DOM-95) | 4-1BB Domain | 432 | 433 |
| DOM-153 (Nucleic acid: DOM-98) | CD3 zeta intracellular domain | 430 | 431 |
| DOM-300 (Nucleic acid: DOM-301) | B7-1 C2 domain | 643 | 644 |
| DOM-292 (Nucleic acid: DOM-293) | B7-1 Hinge | 645 | 646 |
| DOM-294 (Nucleic acid: DOM-295) | B7-1 Transmembrane domain | 647 | 648 |
| DOM-296 (Nucleic acid: DOM-297) | B7-1 tail | 649 | 650 |
| DOM-302 (Nucleic acid: DOM-303) | IgG1 Fc | 65 | 652 |
| DOM-304 (Nucleic acid: DOM-305) | FCgr2b Hinge | 653 | 654 |
| DOM-306 (Nucleic acid: DOM-307) | Short CD8 hinge | 655 | 656 |
| LINK-8 (Nucleic acid: LINK-2305; LINK-2319; LINK-2317) | GS Linker | GS | GGATCC; GGATCA, GGATCT |
| LINK-109 (Nucleic acid: LINK-111; LINK-2346; LINK-2331) | GSG Linker | GSG | GGATCCGGT; GGATCAGGA; GGATCTGGT |
| LINK-13 (Nucleic acid: LINK-17) | (G4S)3 Linker | 421 | 422 |
| LINK-2323 (Nucleic acid: LINK-2372) | Linker (GSGSGSGS) | 424 | 638 |
| LINK-2373 (Nucleic acid: LINK-2374) | Linker (GSGSGSGSGSG) | 639 | 640 |
| LINK-2349 (Nucleic acid: LINK-2350) | Linker (GS)15 | 641, 616 | 642, 622-623 |
| CLEAV-11 (Nucleic acid: CLEAV-12) | P2A cleavage site | 417 | 418 |
| SITE-1 (Nucleic acid: SITE-2) | FasL Shedding Site | 634 | 635 |
| SITE-3 (Nucleic acid: SITE-4) | TNF Shedding Site | 636 | 637 |
| PDE5DD-7 | hPDE5 AA 535-860 of WT (R732L) | 80 | 83 |
| PDE5DD-152 | hPDE5 AA 535-860 of WT (H653A, R732L) | 330 | 331 |
| OT-001893 | IL12B leader; Interleukin-12 subunit beta (p40) (23-328 of WT); Linker (G4S)3 (SEQ ID NO: 421); Interleukin-12 subunit alpha (p35) (57-253 of WT); Linker ((GS)15 (SEQ ID NO: 641)); CD8a Hinge and Transmembrane Domain; Linker (GS); stop | 617 | 624 |
| OT-001949 | IL12B leader; Interleukin-12 subunit beta (p40) (23-328 of WT); Linker (G4S)3 (SEQ ID NO: 421); Interleukin-12 subunit alpha (p35) (57-253 of WT); Linker ((GS)15 (SEQ ID NO: 641)); CD8a Hinge and Transmembrane Domain; Linker (GSG); hPDE5 AA 535-860 of WT (R732L); stop | 618 | 625 |
| OT-001895 | CD8a leader; CD19 scFv; CD8a Hinge and Transmembrane Domain; 4-1BB intracellular domain (CD28 co-stimulatory domain); CD3 zeta intracellular domain; Linker (GS); P2A Cleavage Site; IL12B leader; Interleukin-12 subunit beta (p40) (23-328 of WT); Linker (G4S)3 (SEQ ID NO: 421); Interleukin-12 subunit alpha (p35) (57-253 of WT); Linker ((GS)15 (SEQ ID NO: 641)); CD8a Hinge and Transmembrane Domain; Linker (GS); stop | 619 | 626 |
| OT-001894 | CD8a leader; CD19 scFv; CD8a Hinge and Transmembrane Domain; 4-1BB intracellular domain (CD28 co-stimulatory domain); CD3 zeta intracellular | 620 | 627 |

TABLE 5-continued

Membrane-associated IL12 constructs and its components

| Identifier | Description | AA SEQ ID or Sequence | NA SEQ ID or Sequence |
|---|---|---|---|
| | domain; Linker (GS); P2A Cleavage Site; IL12B leader; Interleukin-12 subunit beta (p40) (23-328 of WT); Linker (G4S)3 (SEQ ID NO: 421); Interleukin-12 subunit alpha (p35) (57-253 of WT); Linker ((GS)15 (SEQ ID NO: 641)); CD8a Hinge and Transmembrane Domain; Linker (GSG); hPDE5 AA 535-860 of WT (R732L); stop | | |
| OT-001891 | CD8a leader; CD19 scFv; CD8a Hinge and Transmembrane Domain; 4-1BB intracellular domain (CD28 co-stimulatory domain); CD3 zeta intracellular domain; Linker (GS); IL12B leader; Interleukin-12 subunit beta (p40) (23-328 of WT); Linker (G4S)3 (SEQ ID NO: 421); Interleukin-12 subunit alpha (p35) (57-253 of WT); Linker ((GS)15 (SEQ ID NO: 641)); CD8a Hinge and Transmembrane Domain; Linker (GSG); hPDE5 AA 535-860 of WT (H653A, R732L); stop | 621 | 628 |
| OT-002111 | Met; CD8a Leader; CD19 scFV; CD8a Hinge and Transmembrane Domain; 4-1BB intracellular signaling domain; CD3 zeta signaling domain; Linker (GS); P2A cleavage site; Met; Interleukin-12 subunit beta (p40) Leader; IL12B (p40) (23-328 of WT); Linker ((G4S)3 (SEQ ID NO: 421)); IL12A (p35) (57-253 of WT); Linker (GSGSGSGS (SEQ ID NO: 424)); B7-1 C2 domain; Linker (GS); stop | 657 | 658 |
| OT-002096 | Met; CD8a Leader; CD19 scFV; CD8a Hinge and Transmembrane Domain; 4-1BB intracellular signaling domain; CD3 zeta signaling domain; Linker (GS); P2A cleavage site; Met; Interleukin-12 subunit beta (p40) Leader; IL12B (p40) (23-328 of WT); Linker ((G4S)3 (SEQ ID NO: 421)); IL12A (p35) (57-253 of WT); Linker (GSGSGSGS (SEQ ID NO: 424)); IgG1 Fc; B7-1 Hinge; B7-1 Transmembrane domain; B7-1 Tail; Linker (GS); stop | 659 | 660 |
| OT-002112 | Met; CD8a Leader; CD19 scFV; CD8a Hinge and Transmembrane Domain; 4-1BB intracellular signaling domain; CD3 zeta signaling domain; Linker (GS); P2A cleavage site; Met; Interleukin-12 subunit beta (p40) Leader; IL12B (p40) (23-328 of WT); Linker ((G4S)3 (SEQ ID NO: 421)); IL12A (p35) (57-253 of WT); Linker (GSGSGSGS (SEQ ID NO: 424)); FCgr2b Hinge; B7-1 Transmembrane Domain; B7-1 Tail; Linker (GS); stop | 661 | 662 |
| OT-002048 | Met; CD8a Leader; CD19 scFV; CD8a Hinge and Transmembrane Domain; 4-1BB intracellular signaling domain; CD3 zeta signaling domain; Linker (GS); | 663 | 664 |

TABLE 5-continued

Membrane-associated IL12 constructs and its components

| Identifier | Description | AA SEQ ID or Sequence | NA SEQ ID or Sequence |
|---|---|---|---|
| | P2A cleavage site; Met; Interleukin-12 subunit beta (p40) Leader; IL12B (p40) (23-328 of WT); Linker ((G4S)3 (SEQ ID NO: 421)); IL12A (p35) (57-253 of WT); Linker (GSGSGSGS (SEQ ID NO: 424)); FasL Shedding Site; CD8a Hinge; CD8a Transmembrane Domain; Linker (GSG); hPDE5 (535-860 of WT, R732L); stop | | |
| OT-002049 | Met; CD8a Leader; CD19 scFV; CD8a Hinge and Transmembrane Domain; 4-1BB intracellular signaling domain; CD3 zeta signaling domain; Linker (GS); P2A cleavage site; Met; Interleukin-12 subunit beta (p40) Leader; IL12B (p40) (23-328 of WT); Linker ((G4S)3 (SEQ ID NO: 421)); IL12A (p35) (57-253 of WT); Linker (GSGSGSGS (SEQ ID NO: 424)); TNF Shedding Site; Linker (GSGSGSGSGSG (SEQ ID NO: 639)); CD8a Transmembrane Domain; Linker (GSG); hPDE5 (535-860 of WT, R732L); stop | 665 | 666 |
| OT-002043 | Met; CD8a Leader; CD19 scFV; CD8a Hinge and Transmembrane Domain; 4-1BB intracellular signaling domain; CD3 zeta signaling domain; Linker (GS); P2A cleavage site; Met; Interleukin-12 subunit beta (p40) Leader; IL12B (p40) (23-328 of WT); Linker ((G4S)3 (SEQ ID NO: 421)); IL12A (p35) (57-253 of WT); Linker ((GS)15 (SEQ ID NO: 641)); CD8a Hinge; B7-1 Transmembrane Domain; B7-1 Tail; Linker (GS); stop | 667 | 668 |
| OT-002011 | Met; CD8a Leader; CD19 scFV; CD8a Hinge and Transmembrane Domain; 4-1BB intracellular signaling domain; CD3 zeta signaling domain; Linker (GS); P2A cleavage site; Met; Interleukin-12 subunit beta (p40) Leader; IL12B (p40) (23-328 of WT); Linker ((G4S)3 (SEQ ID NO: 421)); IL12A (p35) (57-253 of WT); Linker ((GS)15 (SEQ ID NO: 641)); CD8a Hinge; B7-1 Transmembrane Domain; B7-1 Tail; Linker (GS); stop | 669 | 670 |
| OT-001563 | (IL12B (p40) signal sequence; IL12B (p40) (23-328 of WT); Linker ((G4S)3 (SEQ ID NO: 421); IL12A (p35) (57-253 of WT); Linker (GS); stop) | 488 | 489 |

Monocistronic

In one embodiment, the biocircuit and/or effector module of the present disclosure is monocistronic and produces or encodes a single message (e.g., SREs operably linked to a payload of interest). The monocistronic construct may have one region or more than one region that is used to produce a single message (e.g., IL2 or p40 and p35 to produce IL12).

In one embodiment, the biocircuit and/or effector module of the present disclosure is monocistronic where a single payload of interest is produced.

In one embodiment, the monocistronic effector module comprises a payload of interest which is operably linked to a signal sequence. The signal sequence may be on the N or C termini of the payload of interest. The payload of interest and/or the signal sequence may be a wild-type sequence, a fragment of a wild-type sequence and/or comprise one or more mutations. Non-limiting examples of the payload of interest are shown in Table 4. Exemplary monocistronic effector modules are shown in Table 6 which comprise a signal sequence and a payload. Additionally, the amino acid sequences in Table 6 may encode at least one stop codon.

TABLE 6

Monocistronic Effector Modules-Signal Sequence and Payload

| Construct Identifier (Description) | Payload Description | Amino Acid SEQ ID | Nucleic Acid SEQ ID |
|---|---|---|---|
| OT-001010, OT-001399 (CD8a leader; CD19 scFv; CD8a Hinge and Transmembrane Domain; 4-1BB intracellular domain; CD3 zeta signaling domain; stop) | CD19 CAR | 465 | 466 |
| OT-001407 (CD8a leader; CD19 scFv; CD8a Hinge and Transmembrane Domain; 4-1BB intracellular domain; CD3 zeta signaling domain; stop) | CD19 CAR | 465 | 467 |

In one embodiment, the monocistronic effector module comprises an IL2 signal sequence (IL2 leader) which may be operably linked to a payload of interest. Non-limiting examples of a payload of interest which may be operably linked to an IL2 signal sequence include those shown in Table 4.

In one embodiment, the monocistronic effector module comprises an CD8a signal sequence (CD8a leader) which may be operably linked to a payload of interest. Non-limiting examples of a payload of interest which may be operably linked to a CD8a signal sequence include those shown in Table 4. As a non-limiting example, the payload of interest is a CAR. As another non-limiting example, the payload of interest is a CD19 CAR. As another non-limiting example, the payload of interest is a CD19 CAR which include, but is not limited to, a CD19 scFV, CD8a Hinge, transmembrane domain, 4-1BB intracellular domain, and CD3 zeta signaling domain.

In one embodiment, the monocistronic effector module comprises a payload of interest which is operably linked to a signal sequence via a linker. The signal sequence may be on the N or C termini of the payload of interest. The payload of interest and/or the signal sequence may be a wild-type sequence, a fragment of a wild-type sequence and/or comprise one or more mutations. Non-limiting examples of the payload of interest are shown in Table 4.

In one embodiment, the monocistronic effector module comprises a CD8a signal sequence (CD8a leader) which may be operably linked to a payload of interest and the payload of interest is operably linked to a linker. Non-limiting examples of a payload of interest which may be operably linked to a CD8a signal sequence include those shown in Table 4. As a non-limiting example, the payload of interest is a CAR. As another non-limiting example, the payload of interest is a CD19 CAR. As another non-limiting example, the payload of interest is a CD19 CAR which include, but is not limited to, a CD19 scFV, CD8a Hinge, transmembrane domain, 4-1BB intracellular domain, and CD3 zeta signaling domain.

In one embodiment, the monocistronic effector module comprises two payload of interest which is operably linked to a signal sequence via a linker and produces a single message. The signal sequence may be on the N or C termini of each of the payload of interest. The payload of interest and/or the signal sequence may be a wild-type sequence, a fragment of a wild-type sequence and/or comprise one or more mutations. Non-limiting examples of the payload of interest are shown in Table 4.

In one embodiment, the monocistronic effector module comprises a p40 signal sequence (p40 leader) which may be operably linked to a payload of interest. Non-limiting examples of a payload of interest which may be operably linked to a p40 signal sequence include those shown in Table 4. As a non-limiting example, the payloads of interest are p40, p35, a fragment or variant thereof. As another non-limiting example, the payloads of interest are amino acid 23-328 of the wild-type p40 sequence and amino acid 57-253 of wild-type p35 sequence. In one embodiment, the linker is a (G4S)3 linker (SEQ ID NO: 421). In one embodiment, the linker is a BamH1 site (GS).

In one embodiment, the monocistronic effector module comprises two or three payload of interest which is operably linked to a signal sequence and produces a single message. The signal sequence may be on the N or C termini of each of the payload of interest. The payload of interest and/or the signal sequence may be a wild-type sequence, a fragment of a wild-type sequence and/or comprise one or more mutations. Non-limiting examples of the payload of interest are shown in Table 4.

In one embodiment, the monocistronic effector module comprises a CD8a signal sequence (CD8a leader) which may be operably linked to a payload of interest. Non-limiting examples of a payload of interest which may be operably linked to a IgE signal sequence include those shown in Table 4. As a non-limiting example, the payloads of interest are BCMA scFV, CD8a hinge-transmembrane domain, 41BB intracellular domain, CD3 zeta signaling, a fragment or variant thereof.

In one embodiment, the monocistronic effector module produces a single message and comprises at least one payload of interest which is operably linked to a signal sequence, and at least one tag or flag. The effector module may also comprise at least one cleavage site. The signal sequence may be on the N or C termini of each of the payload of interest. The payload of interest and/or the signal sequence may be a wild-type sequence, a fragment of a wild-type sequence and/or comprise one or more mutations. Non-limiting examples of the payload of interest are shown in Table 4.

In one embodiment, the effector module comprises a payload of interest which is operably linked to a signal sequence and a SRE (e.g., destabilizing domain (DD)). The SRE may be on the N or C termini of the payload of interest. The payload of interest and/or the SRE may be a wild-type sequence, a fragment of a wild-type sequence and/or comprise one or more mutations. Non-limiting examples of the payload of interest are shown in Table 4. The effector module may also comprise at least one linker.

In one embodiment, the monocistronic effector module comprises a SRE (e.g., a destabilizing domain (DD)) operably linked to at least one payload of interest. Non-limiting examples of a payload of interest which may be operably linked to a SRE include those shown in Table 4. In one embodiment, the SRE is a destabilizing domain and the destabilizing domain is derived from ecDHFR, FKBP, hDHFR, hPDE5 or a fragment or variant thereof. In some embodiments, the destabilizing domain includes at least one mutation as compared to the wild-type sequence.

In one embodiment, the monocistronic effector module comprises a payload of interest which is operably linked to a signal sequence and a SRE (e.g., destabilizing domain (DD)), and the effector module comprises at least one linker. The SRE may be on the N or C termini of the payload of interest. The payload of interest and/or the SRE may be a wild-type sequence, a fragment of a wild-type sequence and/or comprise one or more mutations. Non-limiting examples of the payload of interest are shown in Table 4. The effector module may also comprise at least one linker.

In one embodiment, the monocistronic effector module comprises a SRE (e.g., a destabilizing domain (DD)) operably linked to at least one payload of interest and includes at least one linker. Non-limiting examples of a payload of interest which may be operably linked to a SRE include those shown in Table 4. In one embodiment, the SRE is a destabilizing domain and the destabilizing domain is derived from ecDHFR, FKBP, hDHFR, hPDE5 or a fragment or variant thereof. In some embodiments, the destabilizing domain includes at least one mutation as compared to the wild-type sequence.

In one embodiment, the monocistronic effector module comprises a payload of interest which is operably linked to a signal sequence, a SRE (e.g., destabilizing domain (DD)), and the effector module comprises at least one linker. The SRE may be on the N or C termini of the payload of interest. The payload of interest and/or the SRE may be a wild-type sequence, a fragment of a wild-type sequence and/or comprise one or more mutations. Non-limiting examples of the payload of interest are shown in Table 4. The effector module may also comprise at least one linker.

In one embodiment, the monocistronic effector module comprises a SRE (e.g., a destabilizing domain (DD)) operably linked to at least one payload of interest, at least one signal sequence and includes at least one linker. Non-limiting examples of a payload of interest which may be operably linked to a SRE include those shown in Table 4. In one embodiment, the SRE is a destabilizing domain and the destabilizing domain is derived from ecDHFR, FKBP, hDHFR, or a fragment or variant thereof. In some embodiments, the destabilizing domain includes at least one mutation as compared to the wild-type sequence.

In one embodiment, the effector module comprises at least one payload of interest which is operably linked to a signal sequence, a SRE (e.g., destabilizing domain (DD)), and the effector module comprises at least one linker. The SRE may be on the N or C termini of the payloads of interest. The payloads of interest and/or the SRE may be a wild-type sequence, a fragment of a wild-type sequence and/or comprise one or more mutations. Non-limiting examples of the payloads of interest are shown in Table 4. The effector module may also comprise at least one linker.

In one embodiment, the monocistronic effector module comprises a SRE (e.g., a destabilizing domain (DD)) operably linked to at least one payload of interest, at least one signal sequence and includes at least one linker. Non-limiting examples of a payload of interest which may be operably linked to a SRE include those shown in Table 4. In one embodiment, the SRE is a destabilizing domain and the destabilizing domain is derived from ecDHFR, FKBP, hDHFR, hPDE5, or a fragment or variant thereof. In some embodiments, the destabilizing domain includes at least one mutation as compared to the wild-type sequence.

In one embodiment, the monocistronic effector module comprises at least one payload of interest which is operably linked to a signal sequence, a SRE (e.g., destabilizing domain (DD)), at least one tag or flag, and the effector module comprises at least one linker. The SRE may be on the N or C termini of the payloads of interest. The payloads of interest and/or the SRE may be a wild-type sequence, a fragment of a wild-type sequence and/or comprise one or more mutations. Non-limiting examples of the payloads of interest are shown in Table 4. The effector module may also comprise at least one linker.

In one embodiment, the monocistronic effector module comprises a SRE (e.g., a destabilizing domain (DD)) operably linked to at least one payload of interest, at least one signal sequence and includes at least one linker and at least one tag and/or flag. Non-limiting examples of a payload of interest which may be operably linked to a SRE include those shown in Table 4. In one embodiment, the SRE is a destabilizing domain and the destabilizing domain is derived from ecDHFR, FKBP, hDHFR, hPDE5, or a fragment or variant thereof. In some embodiments, the destabilizing domain includes at least one mutation as compared to the wild-type sequence. In some embodiments, the effector module includes at least one tag and/or flag sequence.

In one embodiment, the monocistronic effector module comprises at least one payload of interest (e.g., a CAR and/or scFV) which is operably linked to at least one SRE (e.g., destabilizing domain (DD)). The effector module may include at least one signal sequence, at least one tag or flag, at least one linker. The SRE may be on the N or C termini of the payloads of interest. The payloads of interest and/or the SRE may be a wild-type sequence, a fragment of a wild-type sequence and/or comprise one or more mutations. Non-limiting examples of the payloads of interest are shown in Table 4. The effector module may also comprise at least one linker.

In one embodiment, the monocistronic effector module comprises a SRE (e.g., a destabilizing domain (DD)) operably linked to at least one payload of interest (e.g., a CAR and/or scFV). In one embodiment, the SRE is a destabilizing domain and the destabilizing domain is derived from ecDHFR, FKBP, hDHFR, hPDE5, or a fragment or variant thereof. In some embodiments, the destabilizing domain includes at least one mutation as compared to the wild-type sequence. In some embodiments, the effector module includes at least one tag and/or flag sequence.

Multicistronic

In one embodiment, the biocircuit and/or effector module of the present disclosure is multicistronic and produces or encodes more than one message (e.g., SREs operably linked to a payload of interest). The multicistronic construct may utilize various methods known in the art to produce more than one message. Non-limiting examples include IRES, cleavage sites, and more than one SRE.

In one embodiment, the multicistronic effector module comprises a payload of interest. The payload of interest may be a wild-type sequence, a fragment of a wild-type sequence and/or comprise one or more mutations. Non-limiting examples of the payload of interest are shown in Table 4.

In one embodiment, the biocircuit and/or effector module of the present disclosure is multicistronic and produces or encodes two, three, four, five, six, seven, eight, nine, ten, or more than 10 messages (e.g., SREs operably linked to a payload of interest).

Bicistronic

In one embodiment, the biocircuit and/or effector module of the present disclosure is multicistronic and produces or encodes two message (e.g., SREs operably linked to a payload of interest) and is referred to as bicistronic. The bicistronic construct may utilize various methods known in the art to produce more than one message. Non-limiting examples include IRES, cleavage sites, and more than one SRE.

In one embodiment, the bicistronic effector module comprises at least one payload of interest. The payload of interest may be a wild-type sequence, a fragment of a wild-type sequence and/or comprise one or more mutations. Non-limiting examples of the payload of interest are shown in Table 4.

In one embodiment, the bicistronic effector module produces at least two messages and comprises at least one payload of interest which is operably linked to a signal sequence, and at least one cleavage site. The signal sequence may be on the N or C termini of each of the payload of interest. The payload of interest and/or the signal sequence may be a wild-type sequence, a fragment of a wild-type sequence and/or comprise one or more mutations. Non-limiting examples of the payload of interest are shown in Table 4. Exemplary bicistronic effector modules are shown in Table 7 which comprise a signal sequence, at least one payload, at least one linker, and at least one cleavage site. In one embodiment, the linker may be located N or C terminus to the signal sequence or N or C terminus to each the payload and/or cleavage site. In one embodiment, the cleavage site may be located N or C terminus to the signal sequence or N or C terminus to each the payload and/or linker. In Table 7, "WT" means wild-type. Additionally, the amino acid sequences in Table 7 may encode at least one stop codon.

TABLE 7

Bicistronic Effector Module Constructs-Signal Sequence, Payloads, Linker, Cleavage Site

| Construct Identifier (Description) | Payload Description | Amino Acid SEQ ID | Nucleic Acid SEQ ID |
|---|---|---|---|
| OT-001357 (CD8a leader; CD19 scFv; CD8a Hinge and Transmembrane Domain; 4-1BB intracellular domain; CD3 zeta signaling domain; BamHI (GS); P2A Cleavage Site; p40 signal sequence; p40 (23-328 of WT); Linker ((G4S)3) (SEQ ID NO: 421); p35 (57-253 of WT); BamHI (GS); stop) | CD19 CAR, IL12 (p40 and p35) | 468 | 469 |

In one embodiment, the bicistronic effector module comprises an IgE signal sequence (IgE leader) which may be operably linked to at least one payload of interest, at least one linker, and at least one cleavage site. Non-limiting examples of a payload of interest which may be operably linked to a IgE signal sequence include those shown in Table 4. In one embodiment, the linker is a BamH1 site (GS linker). In another embodiment, the linker is a SG3-(SG4)3-SG3-SLQ linker (SEQ ID NO: 671). In one embodiment, the cleavage site is a P2A cleavage site.

In one embodiment, the bicistronic effector module comprises a CD8a signal sequence (CD8a leader) which may be operably linked to at least one payload of interest, at least one linker, and at least one cleavage site. Non-limiting examples of a payload of interest which may be operably linked to a CD8a signal sequence include those shown in Table 4. As a non-limiting example, the payloads of interest are p40, p35, a fragment or variant thereof. In one embodiment the p40 payload is amino acid 23-328 of wild-type. In another embodiment, the p35 payload is amino acid 57-253 of wild-type. In one embodiment, the linker is a BamH1 site (GS linker). In another embodiment, the linker is a SG3-(SG4)3-SG3-SLQ linker (SEQ ID NO: 671). In one embodiment, the cleavage site is a P2A cleavage site. In one embodiment, the cleavage site is a furin cleavage site.

In one embodiment, the bicistronic effector module comprises a CD8a signal sequence (CD8a leader) and a CSF2R signal sequence (CSF2R leader) which may be operably linked to at least one payload of interest, at least one linker, and at least one cleavage site. Non-limiting examples of a payload of interest which may be operably linked to a CD8a signal sequence include those shown in Table 4. In one embodiment, the linker is a BamH1 site (GS linker). In another embodiment, the linker is a SG3-(SG4)3-SG3-SLQ linker (SEQ ID NO: 671). In one embodiment, the cleavage site is a P2A cleavage site. In one embodiment, the cleavage site is a furin cleavage site.

In one embodiment, the bicistronic effector module produces at least two messages and comprises at least one payload of interest which is operably linked to a signal sequence, at least one tag or flag and at least one cleavage site. The signal sequence may be on the N or C termini of each of the payload of interest. The payload of interest and/or the signal sequence may be a wild-type sequence, a fragment of a wild-type sequence and/or comprise one or more mutations. Non-limiting examples of the payload of interest are shown in Table 4. In one embodiment, the linker may be located N or C terminus to the signal sequence or N or C terminus to each the payload and/or cleavage site. In one embodiment, the cleavage site may be located N or C terminus to the signal sequence or N or C terminus to each the payload and/or linker. In one embodiment, the bicistronic effector module comprises an IgE signal sequence (IgE leader) which may be operably linked to at least one payload of interest, at least one linker, and at least one tag or flag. Non-limiting examples of a payload of interest which may be operably linked to a IgE signal sequence include those shown in Table 4. In one embodiment, the linker is a BamH1 site (GS linker). In one embodiment, the linker is a SG3-(SG4)3-SG3-SLQ linker (SEQ ID NO: 671). In another embodiment, the linker is a BamHI site (GS site). In another embodiment, the linker is SG3(SG4)3S (SEQ ID NO: 672) or SG3(SG4)3 (SEQ ID NO. 487). In another embodiment, the linker is SG3S (SEQ ID NO: 673). In one embodiment, the tag is an HA tag. In another embodiment, the tag is a Flag.

In one embodiment, the bicistronic effector module comprises at least one payload of interest which is operably linked to a signal sequence, a SRE (e.g., destabilizing domain (DD)), and the effector module comprises at least one linker and at least one cleavage site. The SREs may be on the N or C termini of the payload of interest. The payloads of interest and/or the SREs may be a wild-type sequence, a fragment of a wild-type sequence and/or comprise one or more mutations. Non-limiting examples of the payload of interest are shown in Table 4. The effector module may also comprise at least one linker.

In one embodiment, the bicistronic effector module comprises at least one payload of interest which is operably linked to a signal sequence, a SRE (e.g., destabilizing domain (DD)), and the bicistronic effector module comprises at least one linker. The nucleic acid sequence of the bicistronic effector module comprises an IRES sequence (SEQ ID NO: 474) and may include at least one spacer (SEQ ID NO: 475-479, TCGCGAATG and TCGCGA). The SREs may be on the N or C termini of the payload of interest. The payloads of interest and/or the SREs may be a wild-type sequence, a fragment of a wild-type sequence and/or comprise one or more mutations. Non-limiting examples of the payload of interest are shown in Table 4. The effector module may also comprise at least one linker. Exemplary bicistronic effector modules are shown in Table 8 which comprise a SRE and a payload. In Table 8, "WT" means wild-type. Additionally, the amino acid sequences in Table 8 may encode at least one stop codon.

In one embodiment, the bicistronic effector module produces at least two messages and comprises at least one payload of interest which is operably linked to a CD8a leader or a IgE leader. The payload of interest and/or the signal sequence may be a wild-type sequence, a fragment of a wild-type sequence and/or comprise one or more mutations. Non-limiting examples of the payload of interest are shown in Table 4.

In one embodiment, the bicistronic effector module produces at least two messages and comprises at least one payload of interest which is operably linked to an IgE leader and a SRE (e.g., destabilizing domain (DD)) derived from ER (estrogen receptor). The payload of interest and/or the signal sequence may be a wild-type sequence, a fragment of a wild-type sequence and/or comprise one or more mutations. Non-limiting examples of the payload of interest are shown in Table 4.

TABLE 8

Bicistronic Effector Module Constructs- Payload, Linkers, DD, IRES

| Construct Identifier | Description | Amino Acid SEQ ID | Nucleic Acid SEQ ID |
| --- | --- | --- | --- |
| OT-001356 | Full Construct (CD8a leader; CD19 scFv; CD8a Hinge and Transmembrane Domain; 4-1BB intracellular domain; CD3 zeta signaling domain; stop; spacer; IRES; spacer; p40 signal sequence; p40 (23-328 of WT); Linker ((G4S)3) (SEQ ID NO: 421); p35 (57-253 of WT); BamHI (GS); stop) | — | 482 |
| | ORF1 (CD8a leader; CD19 scFv; CD8a Hinge and Transmembrane Domain; 4-1BB intracellular domain; CD3 zeta signaling domain; stop) | 480 | 483 |
| | ORF2 (p40 signal sequence; p40 (23-328 of WT); Linker ((G4S)3) (SEQ ID NO: 421); p35 (57-253 of WT); BamHI (GS); stop) | 481 | 484 |

In one embodiment, the bicistronic effector module comprises at least one payload of interest which is operably linked to a signal sequence, at least two SREs (e.g., destabilizing domains (DDs)), and the bicistronic effector module comprises at least one linker. The nucleic acid sequence of the bicistronic effector module comprises an IRES sequence (SEQ ID NO: 474) and may include at least one spacer (SEQ ID NO: 475-479, TCGCGAATG and TCGCGA). The SREs may be on the N or C termini of the payload of interest. The payloads of interest and/or the SREs may be a wild-type sequence, a fragment of a wild-type sequence and/or comprise one or more mutations. Non-limiting examples of the payload of interest are shown in Table 4. The effector module may also comprise at least one linker.

In one embodiment, the bicistronic effector module produces at least two messages and comprises at least one payload of interest which is operably linked to a IgE leader and a SRE (e.g., destabilizing domain (DD)) derived from hPDE5. The payload of interest and/or the signal sequence may be a wild-type sequence, a fragment of a wild-type sequence and/or comprise one or more mutations. Non-limiting examples of the payload of interest are shown in Table 4.

In one embodiment, the bicistronic effector module produces at least two messages and comprises at least one payload of interest which is operably linked to a CD8a leader and a SRE (e.g., destabilizing domain (DD)) derived from either ecDHFR or hDHFR. The payload of interest and/or the signal sequence may be a wild-type sequence, a fragment of a wild-type sequence and/or comprise one or more mutations. Non-limiting examples of the payload of interest are shown in Table 4.

In one embodiment, the bicistronic effector module produces at least two messages and comprises at least one payload of interest which is operably linked to a CD8a leader and a SRE (e.g., destabilizing domain (DD)) derived from ER (estrogen receptor). The payload of interest and/or the signal sequence may be a wild-type sequence, a fragment of a wild-type sequence and/or comprise one or more mutations. Non-limiting examples of the payload of interest are shown in Table 4.

In one embodiment, the bicistronic effector module produces at least two messages and comprises at least one payload of interest which is operably linked to an IL12B (p40) leader and a SRE (e.g., destabilizing domain (DD)) derived from ER (estrogen receptor). The payload of interest and/or the signal sequence may be a wild-type sequence, a fragment of a wild-type sequence and/or comprise one or more mutations. Non-limiting examples of the payload of interest are shown in Table 4.

In one embodiment, the bicistronic effector module produces at least two messages and comprises at least one payload of interest which is operably linked to an IL12B (p40) leader or CD8a leader and a SRE (e.g., destabilizing domain (DD)) derived from ER (estrogen receptor). The payload of interest and/or the signal sequence may be a wild-type sequence, a fragment of a wild-type sequence and/or comprise one or more mutations. Non-limiting examples of the payload of interest are shown in Table 4.

In one embodiment, the bicistronic effector module produces at least two messages and comprises at least one payload of interest which is operably linked to an IL12B (p40) leader or CD8a leader and a SRE (e.g., destabilizing domain (DD)) derived from either ecDHFR or hDHFR. The payload of interest and/or the signal sequence may be a wild-type sequence, a fragment of a wild-type sequence and/or comprise one or more mutations. Non-limiting examples of the payload of interest are shown in Table 4.

In one embodiment, the bicistronic effector module produces at least two messages and comprises at least one payload of interest which is operably linked to an IL12B (p40) leader or CD8a leader. The payload of interest and/or the signal sequence may be a wild-type sequence, a fragment of a wild-type sequence and/or comprise one or more mutations. Non-limiting examples of the payload of interest are shown in Table 4.

Stimuli

Biocircuits of the present disclosure are triggered by one or more stimuli. Stimuli may be selected from a ligand, an externally added or endogenous metabolite, the presence or absence of a defined ligand, pH, temperature, light, ionic strength, radioactivity, cellular location, subject site, microenvironment, the presence or concentration of one or more cations or one or more anions, the presence or action of one or more effector modules, a concentration gradient of ions or biomolecules or the like, or the presence or concentration of one or more metal ions.

Ligands

In some embodiments, the stimulus is a ligand. Ligands may be nucleic acid-based, protein-based, lipid-based, organic, inorganic or any combination of the foregoing.

In some embodiments, the ligand may be, but is not limited to, a protein, peptide, nucleic acid, lipid, lipid derivative, sterol, steroid, metabolite, metabolite derivative, and small molecule.

In some embodiments, the stimulus is a small molecule. In some embodiments, the small molecules are cell permeable. In some embodiments, the small molecules are FDA-approved, safe and orally administered.

In some embodiments, any of the ligands in Table 1 may be useful in the present disclosure.

In some aspects, the ligand binds to FKBP. The ligand may be rapamycin, shield-1, Aquashield, and SLF.

In some embodiments, the ligand binds to dihydrofolate reductase. In some embodiments, the ligand binds to and inhibits dihydrofolate reductase function and is herein referred to as a dihydrofolate inhibitor.

In some embodiments, the ligand may be a selective inhibitor of human DHFR. Ligands of the disclosure may also be selective inhibitors of dihydrofolate reductases of bacteria and parasitic organisms such as *Pneumocystis* spp., *Toxoplasma* spp., *Trypanosoma* spp., *Mycobacterium* spp., and *Streptococcus* spp. Ligands specific to other DHFR may be modified to improve binding to human dihydrofolate reductase.

Examples of dihydrofolate inhibitors include, but are not limited to, Trimethoprim (TMP), Methotrexate (MTX), Pralatrexate, Piritrexim Pyrimethamine, Talotrexin, Chloroguanide, Pentamidine, Trimetrexate, aminopterin, Cl 898 trihydrochloride, Pemetrexed Disodium, Raltitrexed, Sulfaguanidine, Folotyn, Iclaprim and Diaveridine.

In some embodiments, ligands include TMP-derived ligands containing portions of the ligand known to mediate binding to DHFR. Ligands may also be modified to reduce off-target binding to other folate metabolism enzymes and increase specific binding to DHFR.

Ligand Conjugates

In some embodiments, the ligand may be complexed or bound to another molecule such a, but not limited to, another ligand, a protein, peptide, nucleic acid, lipid, lipid derivative, sterol, steroid, metabolite, metabolite derivative or small molecule. In some embodiments, the ligand stimulus is complexed to or bound to one or more other molecules. In some embodiments, the ligand stimulus is complexed or bound to one or more different kinds and/or numbers of other molecules. In some embodiment, the ligand stimulus is a multimer of the same kind of ligand. In some embodiments, the ligand stimulus multimer comprises 2, 3, 4, 5, 6, or more monomers.

Small Molecules

In some embodiments, the stimulus is a small molecule. In some embodiments, the small molecules are cell permeable. In some embodiments, the small molecules useful herein may be non-immunosuppressive, i.e. they do not suppress the hosts innate and acquired immune systems.

Design of SREs from Ligand-Ligand Binding Partner Pairs

In some embodiments, the ligand and ligand binding pairs, may be used as the starting point or reference sequence for the design of one or more SRE's which are responsive to the ligand of the pair. Such design is taught herein and in the Examples.

Embedded Stimulus, Signals or Other Regulatory Moieties

In some embodiments, the effector module of the present disclosure may further comprise one or more microRNAs, microRNA binding sites, promotors and tunable elements.

microRNA

In one embodiment, microRNA may be used in support of the creation of tunable biocircuits. Each aspect or tuned modality may bring to the effector module or biocircuit a differentially tuned feature. For example, a destabilizing domain may alter cleavage sites or dimerization properties or half-life of the payload, and the inclusion of one or more microRNA or microRNA binding site may impart cellular detargeting or trafficking features. Consequently, the present disclosure embraces biocircuits which are multifactorial in their tenability. Such biocircuits and effector modules may be engineered to contain one, two, three, four or more tuned features.

Construct Optimization to Reduce Basal Expression

Biocircuit constructs are to be further optimized to reduce or eliminate the basal expression in the absence of ligands. In some embodiments, an interfering RNA may be used to reduce the basal expression. Other RNA regulatory elements may also be introduced to the construct, for example, by incorporating AU-rich mRNA destabilizing elements (ARE) into the 3' untranslated region (3'UTR) of the construct (Maitra et al., RNA, 2008, 14(5): 950-959).

In some embodiments, a construct may be test with different promoters or mutated promoters. The promoter that gives the least "leaky" expression may be used. In some embodiments, one or more suppressor binding sites may be inserted to the constructs. The suppressor proteins bind to the construct and suppress the expression of the construct in the absence of the stimulus.

Additionally, constructs encoding proteins which can attenuate the transgene activity may also be co-expressed with the biocircuits of the present disclosure.

In some embodiments, effector modules of the present disclosure may include one or more degrons to tune expression. As used herein, a "degron" refers to a minimal sequence within a protein that is sufficient for the recognition and the degradation by the proteolytic system. An important property of degrons is that they are transferrable, that is, appending a degron to a sequence confers degradation upon the sequence. In some embodiments, the degron may be appended to the destabilizing domains, the payload or both. Incorporation of the degron within the effector module of the disclosure, confers additional protein instability to the effector module and may be used to minimize basal expression. In some embodiments, the degron may be an N-degron, a phospho degron, a heat inducible degron, a photosensitive degron, an oxygen dependent degron.

Promoters

In some embodiments, compositions of the disclosure comprise a promoter.

As used herein a promoter is defined as a DNA sequence recognized by transcription machinery of the cell, required to initiate specific transcription of the polynucleotide sequence of the present disclosure. Vectors can comprise native or non-native promoters operably linked to the polynucleotides of the disclosure. The promoters selected may be strong, weak, constitutive, inducible, tissue specific, development stage-specific, and/or organism specific. One example of a suitable promoter is the immediate early cytomegalovirus (CMV) promoter. This promoter sequence is a strong constitutive promoter sequence capable of driving high levels of expression of polynucleotide sequence that is operatively linked to it. Another example of a promoter is Elongation Growth Factor-1 Alpha (EF-1 alpha). Other constitutive promoters may also be used, including, but not limited to simian virus 40 (SV40), mouse mammary tumor virus (MMTV), human immunodeficiency virus (HIV), long terminal repeat (LTR), promoter, an avian leukemia virus promoter, an Epstein-Barr virus immediate early promoter, a Rous sarcoma virus promoter as well as human gene promoters including, but not limited to the phosphoglycerate kinase (PGK) promoter, actin promoter, the myosin promoter, the hemoglobin promoter, the Ubiquitin C (Ubc) promoter, the human U6 small nuclear protein promoter and the creatine kinase promoter. In some instances, inducible promoters such as but not limited to metallothionine promoter, glucocorticoid promoter, a progesterone promoter, and a tetracycline promoter may be used.

In some embodiments, the optimal promoter may be selected based on its ability to achieve minimal expression of the SREs and payloads of the disclosure in the absence of the ligand and detectable expression in the presence of the ligand.

Additional promoter elements e.g. enhancers may be used to regulate the frequency of transcriptional initiation. Such regions may be located 10-100 base pairs upstream or downstream of the start site. In some instances, two or more promoter elements may be used to cooperatively or independently activate transcription.

In some embodiments, the promoter of the disclosure may be a Tet-ON promoter. Combination of the transcription regulation Tet system with the DDs permits simultaneous control of gene expression and protein stability. Any of the dual -Tet ON-DD systems described by Pedone et al. (2018) doi: https://doi.org/10.1101/404699 may be useful in the present disclosure (the contents of which are herein incorporated by reference in their entirety.

Other Regulatory Features

In some embodiments, compositions of the disclosure may include optional proteasome adaptors. As used herein, the term "proteasome adaptor" refers to any nucleotide/amino acid sequence that targets the appended payload for degradation. In some aspects, the adaptors target the payload for degradation directly thereby circumventing the need for ubiquitination reactions. Proteasome adaptors may be used in conjunction with destabilizing domains to reduce the basal expression of the payload. Exemplary proteasome adaptors include the UbL domain of Rad23 or hHR23b, HPV E7 which binds to both the target protein Rb and the S4 subunit of the proteasome with high affinity, which allows direct proteasome targeting, bypassing the ubiquitination machinery; the protein gankyrin which binds to Rb and the proteasome subunit S6.

III. Pharmaceutical Compositions and Formulations

The present teachings further comprise pharmaceutical compositions comprising one or more of the stimuli, biocircuits, effector modules or systems of the present disclosure, and optionally at least one pharmaceutically acceptable excipient or inert ingredient.

As used herein the term "pharmaceutical composition" refers to a preparation of one or more of the biocircuits or components described herein, or pharmaceutically acceptable salts thereof, optionally with other chemical components such as physiologically suitable carriers and excipients.

The term "excipient" or "inactive ingredient" refers to an inert or inactive substance added to a pharmaceutical composition to further facilitate administration of a compound. Non-limiting examples of such inert ingredients are disclosed herein under Formulations.

In some embodiments, compositions are administered to humans, human patients or subjects. For the purposes of the present disclosure, the phrase "active ingredient" generally refers to any one or more biocircuit system component to be delivered as described herein.

Although the descriptions of pharmaceutical compositions provided herein are principally directed to pharmaceutical compositions which are suitable for administration to humans, it will be understood by the skilled artisan that such compositions are generally suitable for administration to any other animal, e.g., to non-human animals, e.g. non-human mammals. Subjects to which administration of the pharmaceutical compositions is contemplated include, but are not limited to, non-human mammals, including agricultural animals such as cattle, horses, chickens and pigs, domestic animals such as cats, dogs, or research animals such as mice, rats, rabbits, dogs and non-human primates.

A pharmaceutical composition in accordance with the disclosure may be prepared, packaged, and/or sold in bulk, as a single unit dose, and/or as a plurality of single unit doses. As used herein, a "unit dose" is discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

Relative amounts of the active ingredient, the pharmaceutically acceptable excipient or inert ingredient, and/or any additional ingredients in a pharmaceutical composition in accordance with the disclosure will vary, depending upon the identity, size, and/or condition of the subject treated and further depending upon the route by which the composition is to be administered. By way of example, the composition may comprise between 0.1% and 100%, e.g., between 0.5 and 50%, between 1-30%, between 5-80%, at least 80% (w/w) active ingredient.

Efficacy of treatment or amelioration of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. In connection with the administration of compositions of the present disclosure, "effective against" for example a cancer, indicates that administration in a clinically appropriate manner results in a beneficial effect for at least a statistically significant fraction of patients, such as an improvement of symptoms, a cure, a reduction in disease load, reduction in tumor mass or cell numbers, extension of life, improvement in quality of life, or other effect generally recognized as positive by medical doctors familiar with treating the particular type of cancer.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given composition or formulation of the present disclosure can also be judged using an experimental animal model for the given disease as known in the art. When using an experimental animal model, efficacy of treatment is evidenced when a statistically significant change is observed.

Formulations

The compositions of the present disclosure may be formulated in any manner suitable for delivery. The formulation may be, but is not limited to, nanoparticles, poly(lactic-co-glycolic acid) (PLGA) microspheres, lipidoids, lipoplex, liposome, polymers, carbohydrates (including simple sugars), cationic lipids and combinations thereof.

In one embodiment, the formulation is a nanoparticle which may comprise at least one lipid. The lipid may be selected from, but is not limited to, DLin-DMA, DLin-K-DMA, 98N12-5, C12-200, DLin-MC3-DMA, DLin-KC2-DMA, DODMA, PLGA, PEG, PEG-DMG and PEGylated lipids. In another aspect, the lipid may be a cationic lipid such as, but not limited to, DLin-DMA, DLin-D-DMA, DLin-MC3-DMA, DLin-KC2-DMA and DODMA.

For polynucleotides of the disclosure, the formulation may be selected from any of those taught, for example, in International Application PCT/US2012/069610, the contents of which are incorporated herein by reference in its entirety.

Inactive Ingredients

In some embodiments, pharmaceutical or other formulations may comprise at least one excipient which is an inactive ingredient. As used herein, the term "inactive ingredient" refers to one or more inactive agents included in formulations. In some embodiments, all, none or some of the inactive ingredients which may be used in the formulations of the present disclosure may be approved by the US Food and Drug Administration (FDA).

IV. Dosing, Delivery and Administrations

The compositions of the disclosure may be delivered to a cell or a subject through one or more routes and modalities. The viral vectors containing one or more effector modules, SREs, payloads and other components described herein may be used to deliver them to a cell and/or a subject. Other modalities may also be used such as mRNAs, plasmids, and as recombinant proteins.

Delivery
Naked Delivery

Pharmaceutical compositions, biocircuits, biocircuit components, effector modules including their SREs or payloads of the present disclosure may be delivered to cells, tissues, organs and/or organisms in naked form. As used herein in, the term "naked" refers to pharmaceutical compositions, biocircuits, biocircuit components, effector modules including their SREs or payloads delivered free from agents or modifications which promote transfection or permeability. The naked pharmaceutical compositions, biocircuits, biocircuit components, effector modules including their SREs or payloads may be delivered to the cells, tissues, organs and/or organisms using routes of administration known in the art and described herein. In some embodiments, naked delivery may include formulation in a simple buffer such as saline or PBS.

Formulated Delivery

In some embodiments, pharmaceutical compositions, biocircuits, biocircuit components, effector modules including their SREs or payloads of the present disclosure may be formulated, using methods described herein. Formulations may comprise pharmaceutical compositions, biocircuits, biocircuit components, effector modules including their SREs or payloads which may be modified and/or unmodified. Formulations may further include, but are not limited to, cell penetration agents, pharmaceutically acceptable carriers, delivery agents, bioerodible or biocompatible polymers, solvents, and/or sustained-release delivery depots. Formulations of the present disclosure may be delivered to cells using routes of administration known in the art and described herein.

Pharmaceutical compositions, biocircuits, biocircuit components, effector modules including their SREs or payloads may also be formulated for direct delivery to organs or tissues in any of several ways in the art including, but not limited to, direct soaking or bathing, via a catheter, by gels, powder, ointments, creams, gels, lotions, and/or drops, by using substrates such as fabric or biodegradable materials coated or impregnated with compositions, and the like.

Delivery to Cells

In another aspect of the disclosure, polynucleotides encoding biocircuits, effector modules, SREs (e.g., DDs), payloads of interest (immunotherapeutic agents) and compositions of the disclosure and vectors comprising said polynucleotides may be introduced into cells such as immune effector cells.

In one aspect of the disclosure, polynucleotides encoding biocircuits, effector modules, SREs (e.g., DDs), payloads of interest (immunotherapeutic agents) and compositions of the disclosure, may be packaged into viral vectors or integrated into viral genomes allowing transient or stable expression of the polynucleotides. Preferable viral vectors are retroviral vectors including lentiviral vectors. In order to construct a retroviral vector, a polynucleotide molecule encoding a biocircuit, an effector module, a DD or a payload of interest (i.e. an immunotherapeutic agent) is inserted into the viral genome in the place of certain viral sequences to produce a virus that is replication-defective. The recombinant viral vector is then introduced into a packaging cell line containing the gag, pol, and env genes, but without the LTR and packaging components. The recombinant retroviral particles are secreted into the culture media, then collected, optionally concentrated, and used for gene transfer. Lentiviral vectors are especially preferred as they are capable of infecting both dividing and non-dividing cells.

Vectors may also be transferred to cells by non-viral methods by physical methods such as needles, electroporation, sonoporation, hyrdoporation; chemical carriers such as inorganic particles (e.g. calcium phosphate, silica, gold) and/or chemical methods. In some embodiments, synthetic or natural biodegradable agents may be used for delivery such as cationic lipids, lipid nano emulsions, nanoparticles, peptide based vectors, or polymer based vectors.

In some embodiments, the polypeptides of the disclosure may be delivered to the cell directly. In one embodiment, the polypeptides of the disclosure may be delivered using synthetic peptides comprising an endosomal leakage domain (ELD) fused to a cell penetration domain (CLD). The polypeptides of the disclosure are co introduced into the cell with the ELD-CLD-synthetic peptide. ELDs facilitate the escape of proteins that are trapped in the endosome, into the cytosol. Such domains are derived proteins of microbial and viral origin and have been described in the art. CPDs allow the transport of proteins across the plasma membrane and have also been described in the art. The ELD-CLD fusion proteins synergistically increase the transduction efficiency when compared to the co-transduction with either domain alone. In some embodiments, a histidine rich domain may optionally be added to the shuttle construct as an additional method of allowing the escape of the cargo from the endosome into the cytosol. The shuttle may also include a cysteine residue at the N or C terminus to generate multimers of the fusion peptide. Multimers of the ELD-CLD fusion peptides generated by the addition of cysteine residue to the terminus of the peptide show even greater transduction efficiency when compared to the single fusion peptide constructs. The polypeptides of the disclosure may also be appended to appropriate localization signals to direct the cargo to the appropriate sub-cellular location e.g. nucleus. In some embodiments any of the ELDs, CLDs or the fusion ELD-CLD synthetic peptides taught in the International Patent Publication, WO2016161516 and WO2017175072 may be useful in the present disclosure (the contents of each of which are herein incorporated by reference in their entirety).

Delivery Modalities and/or Vectors

The biocircuit systems, effector modules, SREs and/or payloads of the present disclosure may be delivered using one or more modalities. The present disclosure also provides vectors that package polynucleotides of the disclosure encoding biocircuits, effector modules, SREs (DDs) and payload constructs, and combinations thereof. Vectors of the present disclosure may also be used to deliver the packaged polynucleotides to a cell, a local tissue site or a subject. These vectors may be of any kind, including DNA vectors, RNA vectors, plasmids, viral vectors and particles. Viral vector technology is well known and described in Sambrook et al. (2001, Molecular Cloning: A Laboratory Manual, Cold Spring Harbor Laboratory, New York). Viruses, which are useful as vectors include, but are not limited to lentiviral vectors, adenoviral vectors, adeno-associated viral (AAV) vectors, herpes simplex viral vectors, retroviral vectors, oncolytic viruses, and the like.

In general, vectors contain an origin of replication functional in at least one organism, a promoter sequence and convenient restriction endonuclease site, and one or more selectable markers e.g. a drug resistance gene.

In some embodiments, the recombinant expression vector may comprise regulatory sequences, such as transcription and translation initiation and termination codons, which are specific to the type of host cell into which the vector is to be introduced.

In some embodiments, the vector of the disclosure may comprise one or more payloads taught herein, wherein the two or more payloads may be included in one effector module. In this case, the two or more payloads are tuned by the same stimulus simultaneously. In other embodiments, the vector of the disclosure may comprise two or more effector modules, wherein each effector module comprises a different payload. In this case, the two or more effector modules and payloads are tuned by different stimuli, providing separately independent regulation of the two or more components.

Lentiviral Vehicles/Particles

In some embodiments, lentiviral vehicles/particles may be used as delivery modalities. Lentiviruses are subgroup of the Retroviridae family of viruses, named because reverse transcription of viral RNA genomes to DNA is required before integration into the host genome. As such, the most important features of lentiviral vehicles/particles are the integration of their genetic material into the genome of a target/host cell. Some examples of lentivirus include the Human Immunodeficiency Viruses: HIV-1 and HIV-2, the Simian Immunodeficiency Virus (SIV), feline immunodeficiency virus (Hy), bovine immunodeficiency virus (BIV), Jembrana Disease Virus (JDV), equine infectious anemia virus (EIAV), equine infectious anemia virus, visna-maedi and caprine arthritis encephalitis virus (CAEV).

Typically, lentiviral particles making up the gene delivery vehicle are replication defective on their own (also referred to as "self-inactivating"). Lentiviruses are able to infect both dividing and non-dividing cells by virtue of the entry mechanism through the intact host nuclear envelope (Naldini L et al., Curr. Opin. Biotechnol, 1998, 9: 457-463). Recombinant lentiviral vehicles/particles have been generated by multiply attenuating the HIV virulence genes, for example, the genes Env, Vif, Vpr, Vpu, Nef and Tat are deleted making the vector biologically safe. Correspondingly, lentiviral vehicles, for example, derived from HIV-1/HIV-2 can mediate the efficient delivery, integration and long-term expression of transgenes into non-dividing cells. As used herein, the term "recombinant" refers to a vector or other nucleic acid containing both lentiviral sequences and non-lentiviral retroviral sequences.

Lentiviral particles may be generated by co-expressing the virus packaging elements and the vector genome itself in a producer cell such as human HEK293T cells. These elements are usually provided in three or four separate plasmids. The producer cells are co-transfected with plasmids that encode lentiviral components including the core (i.e. structural proteins) and enzymatic components of the virus, and the envelope protein(s) (referred to as the packaging systems), and a plasmid that encodes the genome including a foreign transgene, to be transferred to the target cell, the vehicle itself (also referred to as the transfer vector). In general, the plasmids or vectors are included in a producer cell line. The plasmids/vectors are introduced via transfection, transduction or infection into the producer cell line. Methods for transfection, transduction or infection are well known by those of skill in the art. As non-limiting example, the packaging and transfer constructs can be introduced into producer cell lines by calcium phosphate transfection, lipofection or electroporation, generally together with a dominant selectable marker, such as neo, DHFR, Gln synthetase or ADA, followed by selection in the presence of the appropriate drug and isolation of clones.

The producer cell produces recombinant viral particles that contain the foreign gene, for example, the effector module of the present disclosure. The recombinant viral particles are recovered from the culture media and titrated by standard methods used by those of skill in the art. The recombinant lentiviral vehicles can be used to infect target cells.

Cells that can be used to produce high-titer lentiviral particles may include, but are not limited to, HEK293T cells, 293G cells, STAR cells (Relander et al., *Mol. Ther.*, 2005, 11: 452-459), FreeStyle™ 293 Expression System (ThermoFisher, Waltham, Mass.), and other HEK293T-based producer cell lines (e.g., Stewart et al., *Hum Gene Ther.* 2011, 22(3):357-369; Lee et al., *Biotechnol Bioeng*, 2012, 10996): 1551-1560; Throm et al., *Blood.* 2009, 113(21): 5104-5110; the contents of each of which are incorporated herein by reference in their entirety).

In some aspects, the envelope proteins may be heterologous envelop proteins from other viruses, such as the G protein of vesicular stomatitis virus (VSV G) or baculoviral gp64 envelop proteins. The VSV-G glycoprotein may especially be chosen among species classified in the vesiculovirus genus: *Carajas* virus (CJSV), Chandipura virus (CHPV), Cocal virus (COCV), *Isfahan* virus (ISFV), *Maraba* virus (MARAV), *Piry* virus (PIRYV), Vesicular stomatitis *Alagoas* virus (VSAV), Vesicular stomatitis Indiana virus (VSIV) and Vesicular stomatitis New Jersey virus (VSNJV) and/or stains provisionally classified in the vesiculovirus genus as Grass carp rhabdovirus, BeAn 157575 virus (BeAn 157575), Boteke virus (BTKV), *Calchaqui* virus (CQIV), Eel virus American (EVA), Gray Lodge virus (GLOV), Jurona virus (JURY), Klamath virus (KLAV), *Kwatta* virus (KWAV), La Joya virus (LJV), Malpais Spring virus (MSPV), Mount Elgon bat virus (MEBV), *Perinet* virus (PERV), Pike fry rhabdovirus (PFRV), Porton virus (PORV), Radi virus (RADIV), Spring viremia of carp virus (SVCV), *Tupaia* virus (TUPV), Ulcerative disease rhabdovirus (UDRV) and Yug Bogdanovac virus (YBV). The gp64 or other baculoviral env protein can be derived from *Autographa californica* nucleopolyhedrovirus (AcMNPV), *Anagrapha falcifera* nuclear polyhedrosis virus, *Bombyx mori* nuclear polyhedrosis virus, *Choristoneura fumiferana* nucleopolyhedrovirus, *Orgyia pseudotsugata* single capsid nuclear polyhedrosis virus, *Epiphyas postvittana* nucleopolyhedrovirus, *Hyphantria cunea* nucleopolyhedrovirus, *Galleria mellonella* nuclear polyhedrosis virus, Dhori virus, Thogoto virus, *Antheraea pemyi* nucleopolyhedrovirus or Batken virus.

Other elements provided in lentiviral particles may comprise retroviral LTR (long-terminal repeat) at either 5' or 3' terminus, a retroviral export element, optionally a lentiviral reverse response element (RRE), a promoter or active portion thereof, and a locus control region (LCR) or active portion thereof. The effector module is linked to the vector.

Methods for generating recombinant lentiviral particles are discussed in the art, for example, U.S. Pat. Nos. 8,846, 385; 7,745,179; 7,629,153; 7,575,924; 7,179,903; and 6,808,905; the contents of each of which are incorporated herein by reference in their entirety.

Lentivirus vectors used may be selected from, but are not limited to pLVX, pLenti, pLenti6, pLJM1, FUGW, pWPXL, pWPI, pLenti CMV puro DEST, pLJM1-EGFP, pULTRA, pInducer20, pHIV-EGFP, pCW57.1, pTRPE, pELPS, pRRL, and pLionII.

Adeno-Associated Viral Particles

Delivery of any of the biocircuits, biocircuit components, effector modules, SREs or payload constructs of the present disclosure may be achieved using recombinant adeno-associated viral (rAAV) vectors. Such vectors or viral particles may be designed to utilize any of the known serotype capsids or combinations of serotype capsids.

AAV vectors include not only single stranded vectors but self-complementary AAV vectors (scAAVs). scAAV vectors contain DNA which anneals together to form double stranded vector genome. By skipping second strand synthesis, scAAVs allow for rapid expression in the cell.

The rAAV vectors may be manufactured by standard methods in the art such as by triple transfection, in sf9 insect cells or in suspension cell cultures of human cells such as HEK293 cells.

The biocircuits, biocircuit components, effector modules, SREs or payload constructs may be encoded in one or more viral genomes to be packaged in the AAV capsids taught herein.

Such vector or viral genomes may also include, in addition to at least one or two ITRs (inverted terminal repeats), certain regulatory elements necessary for expression from the vector or viral genome. Such regulatory elements are well known in the art and include for example promoters, introns, spacers, stuffer sequences, and the like.

The biocircuits, biocircuit components, effector modules, SREs or payload constructs of the disclosure may be administered in one or more AAV particles.

In some embodiments, the effector modules may be administered in one or more AAV particles. In some embodiments, more than one effector module or SRE may be encoded in a viral genome.

Retroviral Vehicles/Particles (γ-Retroviral Vectors)

In some embodiments, retroviral vehicles/particles may be used to deliver the biocircuits, biocircuit components, effector modules, SREs or payload constructs of the present disclosure. Retroviral vectors (RVs) allow the permanent integration of a transgene in target cells. In addition to lentiviral vectors based on complex HIV-1/2, retroviral vectors based on simple gamma-retroviruses have been widely used to deliver therapeutic genes and demonstrated clinically as one of the most efficient and powerful gene delivery systems capable of transducing a broad range of cell types. Example species of Gamma retroviruses include the murine leukemia viruses (MLVs) and the feline leukemia viruses (FeLV).

In some embodiments, gamma-retroviral vectors derived from a mammalian gamma-retrovirus such as murine leukemia viruses (MLVs), are recombinant. The MLV families of gamma retroviruses include the ecotropic, amphotropic, xenotropic and polytropic subfamilies. Ecotropic viruses are able to infect only murine cells using mCAT-1 receptor. Examples of ecotropic viruses are Moloney MLV and AKV. Amphotropic viruses infect murine, human and other species through the Pit-2 receptor. One example of an amphotropic virus is the 4070A virus. Xenotropic and polytropic viruses utilize the same (Xpr1) receptor, but differ in their species tropism. Xenotropic viruses such as NZB-9-1 infect human and other species but not murine species, whereas polytropic viruses such as focus-forming viruses (MCF) infect murine, human and other species.

Gamma-retroviral vectors may be produced in packaging cells by co-transfecting the cells with several plasmids including one encoding the retroviral structural and enzymatic (gag-pol) polyprotein, one encoding the envelope (env) protein, and one encoding the vector mRNA comprising polynucleotide encoding the compositions of the present disclosure that is to be packaged in newly formed viral particles.

In some aspects, the recombinant gamma-retroviral vectors are pseudotyped with envelope proteins from other viruses. Envelope glycoproteins are incorporated in the outer lipid layer of the viral particles which can increase/alter the cell tropism.

In some embodiments, the recombinant gamma-retroviral vectors are self-inactivating (SIN) gammaretroviral vectors. The vectors are replication incompetent. SIN vectors may harbor a deletion within the 3' U3 region initially comprising enhancer/promoter activity. Furthermore, the 5' U3 region may be replaced with strong promoters (needed in the packaging cell line) derived from Cytomegalovirus or RSV, or an internal promotor of choice, and/or an enhancer element. The choice of the internal promotors may be made according to specific requirements of gene expression needed for a particular purpose of the disclosure.

In some embodiments, polynucleotides encoding the biocircuit, biocircuit components, effector module, SRE are inserted within the recombinant viral genome. The other components of the viral mRNA of a recombinant gamma-retroviral vector may be modified by insertion or removal of naturally occurring sequences (e.g., insertion of an IRES, insertion of a heterologous polynucleotide encoding a polypeptide or inhibitory nucleic acid of interest, shuffling of a more effective promoter from a different retrovirus or virus in place of the wild-type promoter and the like). In some examples, the recombinant gamma-retroviral vectors may comprise modified packaging signal, and/or primer binding site (PBS), and/or 5'-enhancer/promoter elements in the U3-region of the 5'-long terminal repeat (LTR), and/or 3'-SIN elements modified in the U3-region of the 3'-LTR. These modifications may increase the titers and the ability of infection.

Oncolytic Viral Vector

In some embodiments, polynucleotides of present disclosure may be packaged into oncolytic viruses. As used herein, the term "oncolytic virus" refers to a virus that preferentially infects and kills cancer cells such as vaccine viruses. An oncolytic virus can occur naturally or can be a genetically modified virus such as oncolytic adenovirus, and oncolytic herpes virus.

In some embodiments, oncolytic vaccine viruses may include viral particles of a thymidine kinase (TK)-deficient, granulocyte macrophage (GM)-colony stimulating factor (CSF)-expressing, replication-competent vaccinia virus vector sufficient to induce oncolysis of cells in the tumor; See e.g., U.S. Pat. No. 9,226,977; the contents of which are incorporated herein by reference in their entirety.

Messenger RNA (mRNA)

In some embodiments, the effector modules of the disclosure may be designed as a messenger RNA (mRNA). As used herein, the term "messenger RNA" (mRNA) refers to any polynucleotide which encodes a polypeptide of interest and which is capable of being translated to produce the encoded polypeptide of interest in vitro, in vivo, in situ or ex vivo. Such mRNA molecules may have the structural components or features of any of those taught in International Application number PCT/US2013/030062, the contents of which are incorporated herein by reference in its entirety.

In some embodiments, the effector modules may be designed as self-amplifying RNA. "Self-amplifying RNA" as used herein refers to RNA molecules that can replicate in the host resulting in the increase in the amount of the RNA and the protein encoded by the RNA. Such self-amplifying RNA may have structural features or components of any of those taught in International Patent Application Publication No. WO2011005799 (the contents of which are incorporated herein by reference in their entirety).

Dosing

The present disclosure provides methods comprising administering any one or more or component of a biocircuit system to a subject in need thereof. These may be administered to a subject using any amount and any route of administration effective for preventing or treating or imaging a disease, disorder, and/or condition (e.g., a disease, disorder, and/or condition relating to working memory deficits). The exact amount required will vary from subject to subject, depending on the species, age, and general condition of the subject, the severity of the disease, the particular composition, its mode of administration, its mode of activity, and the like.

Compositions in accordance with the disclosure are typically formulated in dosage unit form for ease of administration and uniformity of dosage. It will be understood, however, that the total daily usage of the compositions of the present disclosure may be decided by the attending physician within the scope of sound medical judgment. The specific therapeutically effective, prophylactically effective, or appropriate imaging dose level for any particular patient will depend upon a variety of factors including the disorder being treated and the severity of the disorder; the activity of the specific compound employed; the specific composition employed; the age, body weight, general health, sex and diet of the patient; the time of administration, route of administration, and rate of excretion of the specific compound employed; the duration of the treatment; drugs used in combination or coincidental with the specific compound employed; and like factors well known in the medical arts.

Compositions of the disclosure may be used in varying doses to avoid T cell energy, prevent cytokine release syndrome and minimize toxicity associated with immunotherapy. For example, low doses of the compositions of the present disclosure may be used to initially treat patients with high tumor burden, while patients with low tumor burden may be treated with high and repeated doses of the compositions of the disclosure to ensure recognition of a minimal tumor antigen load. In another instance, the compositions of the present disclosure may be delivered in a pulsatile fashion to reduce tonic T cell signaling and enhance persistence in vivo. In some aspects, toxicity may be minimized by initially using low doses of the compositions of the disclosure, prior to administering high doses. Dosing may be modified if serum markers such as ferritin, serum C-reactive protein, IL6, IFN-γ, and TNF-α are elevated.

In some embodiments, the neurotoxicity may be associated with CAR or TIL therapy. Such neurotoxicity may be associated CD19-CARs. Toxicity may be due to excessive T cell infiltration into the brain. In some embodiments, neurotoxicity may be alleviated by preventing the passage of T cells through the blood brain barrier. This can be achieved by the targeted gene deletion of the endogenous alpha-4 integrin inhibitors such as tysabri/natalizumab may also be useful in the present disclosure.

Also provided herein are methods of administering ligands in accordance with the disclosure to a subject in need thereof. The ligand may be administered to a subject or to cells, using any amount and any route of administration effective for tuning the biocircuits of the disclosure. The exact amount required will vary from subject to subject, depending on the species, age, and general condition of the subject, the severity of the disease, the particular composition, its mode of administration, its mode of activity, and the like. The subject may be a human, a mammal, or an animal. Compositions in accordance with the disclosure are typically formulated in unit dosage form for ease of administration and uniformity of dosage. It will be understood, however, that the total daily usage of the compositions of the present disclosure may be decided by the attending physician within the scope of sound medical judgment. In certain embodiments, the ligands in accordance with the present disclosure may be administered at dosage levels sufficient to deliver from about 0.0001 mg/kg to about 100 mg/kg, from about 0.001 mg/kg to about 0.05 mg/kg, from about 0.005 mg/kg to about 0.05 mg/kg, from about 0.001 mg/kg to about 0.005 mg/kg, from about 0.05 mg/kg to about 0.5 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, from about 10 mg/kg to about 100 mg/kg, from about 50 mg/kg to about 500 mg/kg, from about 100 mg/kg to about 1000 mg/kg, of subject body weight per day, one or more times a day, to obtain the desired effect. In some embodiments, the dosage levels may be 1 mg/kg, 5 mg/kg, 10 mg/kg, 20 mg/kg, 30 mg/kg, 40 mg/kg, 50 mg/kg, 60 mg/kg, 70 mg/kg, 80 mg/kg, 90 mg/kg, 100 mg/kg, 100 mg/kg, 110 mg/kg, 120 mg/kg, 130 mg/kg, 140 mg/kg, 150 mg/kg, 160 mg/kg, 170 mg/kg, 180 mg/kg, 190 mg/kg or mg/kg of subject body weight per day, or more times a day, to obtain the desired effect.

The present disclosure provides methods for delivering to a cell or tissue any of the ligands described herein, comprising contacting the cell or tissue with said ligand and can be accomplished in vitro, ex vivo, or in vivo. In certain embodiments, the ligands in accordance with the present disclosure may be administered to cells at dosage levels sufficient to deliver from about 1 nM to about 10 nM, from about 5 nM to about 50 nM, from about 10 nM to about 100 nM, from about 50 nM to about 500 nM, from about 100 nM to about 1000 nM, from about 1 µM to about 10 µM from about 5 µM to about 50 µM from about 10 µM to about 100 µM from about 25 µM to about 250 µM from about 50 µM to about 500 µM. In some embodiments, the ligand may be administered to cells at doses selected from but not limited to 0.00064 µM, 0.0032 µM, 0.016 µM, 0.08 µM, 0.4 µM, 1 µM 2 µM, 10 µM, 50 µM, 75, µM, 100 µM, 150 µM, 175 µM, 200 µM, 250 µM.

The desired dosage of the ligands of the present disclosure may be delivered only once, three times a day, two times a day, once a day, every other day, every third day, every week, every two weeks, every three weeks, or every four weeks. In certain embodiments, the desired dosage may be delivered using multiple administrations (e.g., two, three, four, five, six, seven, eight, nine, ten, eleven, twelve, thirteen, fourteen, or more administrations). When multiple administrations are employed, split dosing regimens such as those described herein may be used. As used herein, a "split dose" is the division of "single unit dose" or total daily dose into two or more doses, e.g., two or more administrations of the "single unit dose". As used herein, a "single unit dose" is a dose of any therapeutic administered in one dose/at one time/single route/single point of contact, i.e., single administration event. The desired dosage of the ligand of the present disclosure may be administered as a "pulse dose" or as a "continuous flow". As used herein, a "pulse dose" is a series of single unit doses of any therapeutic administered with a set frequency over a period of time. As used herein, a "continuous flow" is a dose of therapeutic administered continuously for a period of time in a single route/single point of contact, i.e., continuous administration event. A total daily dose, an amount given or prescribed in 24-hour period, may be administered by any of these methods, or as a combination of these methods, or by any other methods suitable for a pharmaceutical administration.

Administration

In some embodiments, the compositions for immunotherapy may be administered to cells ex vivo and subsequently administered to the subject. Immune cells can be isolated and expanded ex vivo using a variety of methods known in the art. For example, methods of isolating cytotoxic T cells are described in U.S. Pat. Nos. 6,805,861 and 6,531,451; the contents of each of which are incorporated herein by reference in their entirety. Isolation of NK cells is described in U.S. Pat. No. 7,435,596; the contents of which are incorporated by reference herein in its entirety.

In some embodiments, depending upon the nature of the cells, the cells may be introduced into a host organism e.g. a mammal, in a wide variety of ways including by injection, transfusion, infusion, local instillation or implantation. In some aspects, the cells of the disclosure may be introduced at the site of the tumor. The number of cells that are employed will depend upon a number of circumstances, the purpose for the introduction, the lifetime of the cells, the protocol to be used, for example, the number of administrations, the ability of the cells to multiply, or the like. The cells may be in a physiologically-acceptable medium.

In some embodiments, the cells of the disclosure may be administrated in multiple doses to subjects having a disease or condition. The administrations generally effect an improvement in one or more symptoms of cancer or a clinical condition and/or treat or prevent cancer or clinical condition or symptom thereof.

In some embodiments, the compositions for immunotherapy may be administered in vivo. In some embodiments, polypeptides of the present disclosure comprising biocircuits, effector molecules, SREs, payloads of interest (immunotherapeutic agents) and compositions of the disclosure may be delivered in vivo to the subject. In vivo delivery of immunotherapeutic agents is well described in the art. For example, methods of delivery of cytokines are described in the E.P. Pat. NO. EP0930892 A1, the contents of which are incorporated herein by reference.

In one embodiment, the payloads of the present disclosure may be administered in conjunction with inhibitors of SHP-1 and/or SHP-2. The tyrosine-protein phosphatase SHP1 (also known as PTPN6) and SHP2 (also known as PTPN11) are involved in the Programmed Cell Death (PD1) inhibitory signaling pathway. The intracellular domain of PD1 contains an immunoreceptor tyrosine-based inhibitory motif (ITIM) and an immunoreceptor tyrosine-based switch motif (ITSM). ITSM has been shown to recruit SHP-1 and 2. This generates negative costimulatory micro clusters that induce the dephosphorylation of the proximal TCR signaling molecules, thereby resulting in suppression of T cell activation, which can lead to T cell exhaustion. In one embodiment, inhibitors of SHP-1 and 2 may include expressing dominant negative versions of the proteins in T cells, TILs or other cell types to relieve exhaustion. Such mutants can bind to the endogenous, catalytically active proteins, and inhibit their function. In one embodiment, the dominant negative mutant of SHP-1 and/or SHP-2 lack the phosphatase domain required for catalytic activity. In some embodiments, any of the dominant negative SHP-1 mutants taught Bergeron S et al. (2011). Endocrinology. 2011 December; 152(12):4581-8.; Dustin J B et al. (1999) J Immunol. March 1; 162(5):2717-24.; Berchtold S (1998) Mol Endocrinol. April; 12(4):556-67 and Schram et al. (2012) Am J Physiol Heart Circ Physiol. 1; 302(1):H231-

43.; may be useful in the disclosure (the contents of each of which are incorporated by reference in their entirety).

Routes of Delivery

The pharmaceutical compositions, biocircuits, biocircuit components, effector modules including their SREs (e.g., DDs), payloads (i.e. immunotherapeutic agents), vectors and cells of the present disclosure may be administered by any route to achieve a therapeutically effective outcome.

The pharmaceutical compositions, biocircuits, biocircuit components, effector modules including their SREs or payloads of the present disclosure may be administered by any route to achieve a therapeutically effective outcome. These include, but are not limited to enteral (into the intestine), gastroenteral, epidural (into the dura matter), oral (by way of the mouth), transdermal, peridural, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), in ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliary, intrabronchial, intrabursal, intracartilaginous (within a cartilage), intracaudal (within the cauda equine), intracisternal (within the cisterna magna cerebellomedularis), intracorneal (within the cornea), dental intracornal, intracoronary (within the coronary arteries), intracorporus cavernosum (within the dilatable spaces of the corpus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intramyocardial (within the myocardium), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration which is then covered by a dressing which occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), intramyocardial (entering the myocardium), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis or spinal.

Parenteral and Injectable Administration

In some embodiments, pharmaceutical compositions, biocircuits, biocircuit components, effector modules including their SREs or payloads of the present disclosure may be administered parenterally. Liquid dosage forms for oral and parenteral administration include, but are not limited to, pharmaceutically acceptable emulsions, microemulsions, solutions, suspensions, syrups, and/or elixirs. In addition to active ingredients, liquid dosage forms may comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, oral compositions can include adjuvants such as wetting agents, emulsifying and suspending agents, sweetening, flavoring, and/or perfuming agents. In certain embodiments for parenteral administration, compositions are mixed with solubilizing agents such as CREMOPHOR®, alcohols, oils, modified oils, glycols, polysorbates, cyclodextrins, polymers, and/or combinations thereof. In other embodiments, surfactants are included such as hydroxypropylcellulose.

Injectable preparations, for example, sterile injectable aqueous or oleaginous suspensions may be formulated according to the known art using suitable dispersing agents, wetting agents, and/or suspending agents. Sterile injectable preparations may be sterile injectable solutions, suspensions, and/or emulsions in nontoxic parenterally acceptable diluents and/or solvents, for example, as a solution in 1,3-butanediol. Among the acceptable vehicles and solvents that may be employed are water, Ringer's solution, U.S.P., and isotonic sodium chloride solution. Sterile, fixed oils are conventionally employed as a solvent or suspending medium. For this purpose, any bland fixed oil can be employed including synthetic mono- or diglycerides. Fatty acids such as oleic acid can be used in the preparation of injectables.

Injectable formulations may be sterilized, for example, by filtration through a bacterial-retaining filter, and/or by incorporating sterilizing agents in the form of sterile solid compositions which can be dissolved or dispersed in sterile water or other sterile injectable medium prior to use.

Detectable Agents and Labels

The stimuli, biocircuit systems and components, effector modules including the SREs and payloads may be associated with or bound to one or more radioactive agents or detectable agents.

These agents include various organic small molecules, inorganic compounds, nanoparticles, enzymes or enzyme substrates, fluorescent materials, luminescent materials (e.g., luminol), bioluminescent materials (e.g., luciferase, luciferin, and aequorin), chemiluminescent materials, radioactive materials (e.g., $^{18}F$, $^{67}Ga$, $^{81m}Kr$, $^{82}Rb$, $^{111}In$, $^{123}I$, $^{133}Xe$, $^{201}Tl$, $^{125}I$, $^{35}S$, $^{14}C$, $^{3}H$, or $^{99m}Tc$ (e.g., as pertechnetate (technetate(VII), $TcO_4^-$)), and contrast agents (e.g., gold (e.g., gold nanoparticles), gadolinium (e.g., chelated Gd), iron oxides (e.g., superparamagnetic iron oxide (SPIO), monocrystalline iron oxide nanoparticles (MIONs), and ultrasmall superparamagnetic iron oxide (USPIO)), manganese chelates (e.g., Mn-DPDP), barium sulfate, iodinated contrast media (iohexol), microbubbles, or perfluorocarbons).

In some embodiments, the detectable agent may be a non-detectable precursor that becomes detectable upon activation (e.g., fluorogenic tetrazine-fluorophore constructs (e.g., tetrazine-BODIPY FL, tetrazine-Oregon Green 488, or tetrazine-BODIPY TMR-X) or enzyme activatable fluorogenic agents (e.g., PROSENSE® (VisEn Medical))). In vitro assays in which the enzyme labeled compositions can be used include, but are not limited to, enzyme linked immunosorbent assays (ELISAs), immunoprecipitation assays, immunofluorescence, enzyme immunoassays (EIA), radioimmunoassays (RIA), and Western blot analysis.

V. Applications

The biocircuits, effector modules, SREs, stimuli, compositions or systems comprising one or more of the stimuli, biocircuits, effector modules of the present disclosure may be utilized in a large variety of applications including, but not limited to, therapeutics, diagnosis and prognosis, bioengineers, bioprocessing, biofactory, research agents, metabolomics, gene expression, enzyme replacement, etc.

Therapeutic Uses

Cancer Immunotherapy

Cancer immunotherapy aims at the induction or restoration of the reactivity of the immune system towards cancer. Significant advances in immunotherapy research have led to the development of various strategies which may broadly be classified into active immunotherapy and passive immunotherapy. In general, these strategies may be utilized to directly kill cancer cells or to counter the immunosuppressive tumor microenvironment. Active immunotherapy aims at induction of an endogenous, long-lasting tumor-antigen specific immune response. The response can further be enhanced by non-specific stimulation of immune response modifiers such as cytokines. In contrast, passive immunotherapy includes approaches where immune effector molecules such as tumor-antigen specific cytotoxic T cells or antibodies are administered to the host. This approach is short lived and requires multiple applications.

Despite significant advances, the efficacy of current immunotherapy strategies is limited by associated toxicities. These are often related to the narrow therapeutic window associated with immunotherapy, which in part, emerges from the need to push therapy dose to the edge of potentially fatal toxicity to get a clinically meaningful treatment effect. Further, dose expands in vivo since adoptively transferred immune cells continue to proliferate within the patient, often unpredictably.

A major risk involved in immunotherapy is the on-target but off tumor side effects resulting from T-cell activation in response to normal tissue expression of the tumor associated antigen (TAA). Clinical trials utilizing T cells expressing T-cell receptor against specific TAA reported skin rash, colitis and hearing loss in response to immunotherapy.

Immunotherapy may also produce on target, on-tumor toxicities that emerge when tumor cells are killed in response to the immunotherapy. The adverse effects include tumor lysis syndrome, cytokine release syndrome and the related macrophage activation syndrome. Importantly, these adverse effects may occur during the destruction of tumors, and thus even a successful on-tumor immunotherapy might result in toxicity. Approaches to regulatably control immunotherapy are thus highly desirable since they have the potential to reduce toxicity and maximize efficacy.

The present disclosure provides systems, compositions, immunotherapeutic agents and methods for cancer immunotherapy. These compositions provide tunable regulation of gene expression and function in immunotherapy. The present disclosure also provides biocircuit systems, effector modules, stimulus response elements (SREs) and payloads, as well as polynucleotides encoding any of the foregoing. In one aspect, the systems, compositions, immunotherapeutic agents and other components of the disclosure can be controlled by a separately added stimulus, which provides a significant flexibility to regulate cancer immunotherapy. Further, the systems, compositions and the methods of the present disclosure may also be combined with therapeutic agents such as chemotherapeutic agents, small molecules, gene therapy, and antibodies.

The tunable nature of the systems and compositions of the disclosure has the potential to improve the potency and duration of the efficacy of immunotherapies. Reversibly silencing the biological activity of adoptively transferred cells using compositions of the present disclosure allows maximizing the potential of cell therapy without irretrievably killing and terminating the therapy.

The present disclosure provides methods for fine tuning of immunotherapy after administration to patients. This in turn improves the safety and efficacy of immunotherapy and increases the subject population that may benefit from immunotherapy.

In one embodiment, the biocircuit systems, effector modules, SREs, and components that tune expression levels and activities of any agents may be used for immunotherapy. As non-limiting examples, an immunotherapeutic agent may be an antibody and fragments and variants thereof, a cancer specific T cell receptor (TCR) and variants thereof, an anti-tumor specific chimeric antigen receptor (CAR), a chimeric switch receptor, an inhibitor of a co-inhibitory receptor or ligand, an agonist of a co-stimulatory receptor and ligand, a cytokine, chemokine, a cytokine receptor, a chemokine receptor, a soluble growth factor, a metabolic factor, a suicide gene, a homing receptor, or any agent that induces an immune response in a cell and a subject.

In some embodiments, the composition for inducing an immune response may comprise an effector module. In some embodiments, the effector module may comprise a stimulus response element (SRE) operably linked to at least one payload. In one aspect, the payload may be an immunotherapeutic agent.

In some embodiments, biocircuit systems, effector modules, and compositions of the present disclosure relate to post-translational regulation of protein (payload) function anti-tumor immune responses of immunotherapeutic agents.

1. Adoptive Cell Transfer (Adoptive Immunotherapy)

In some embodiments, cells which are genetically modified to express at least one biocircuit system, effector module, DD, and/or payload of interest (immunotherapeutic agent) may be used for adoptive cell therapy (ACT). As used herein, Adoptive cell transfer refers to the administration of immune cells (from autologous, allogenic or genetically modified hosts) with direct anticancer activity. ACT has shown promise in clinical application against malignant and infectious disease According to the present disclosure, the biocircuits and systems may be used in the development and implementation of cell therapies such as adoptive cell therapy. Certain effector modules useful in cell therapy are given in FIGS. 7-12 in International Publication No. WO2017/180587, the contents of which are herein incorporated by reference in their entirety. The biocircuits, their components, effector modules and their SREs and payloads may be used in cell therapies to effect CAR therapies, in the manipulation or regulation of TILs, in allogeneic cell therapy, in combination T cell therapy with other treatment lines (e.g. radiation, cytokines), to encode engineered TCRs, or modified TCRs, or to enhance T cells other than TCRs (e.g. by introducing cytokine genes, genes for the checkpoint inhibitors PD1, CTLA4).

Provided herein are methods for use in adoptive cell therapy. The methods involve preconditioning a subject in need thereof, modulating immune cells with SRE, biocircuits and compositions of the present disclosure, administering to a subject, engineered immune cells expressing compositions of the disclosure and the successful engraftment of engineered cells within the subject.

In some embodiments, SREs, biocircuits and compositions of the present disclosure may be used to minimize preconditioning regimens associated with adoptive cell therapy. As used herein "preconditioning" refers to any therapeutic regimen administered to a subject to improve the outcome of adoptive cell therapy. Preconditioning strategies include, but are not limited to total body irradiation and/or lymphodepleting chemotherapy. Adoptive therapy clinical trials without preconditioning have failed to demonstrate any clinical benefit, indicating its importance in ACT. Yet, preconditioning is associated with significant toxicity and limits the subject cohort that is suitable for ACT. In some instances, immune cells for ACT may be engineered to express cytokines such as IL12 as payload using SREs of the present disclosure to reduce the need for preconditioning.

In some embodiments, immune cells for ACT may be dendritic cells, T cells such as $CD8^+$ T cells and $CD4^+$ T cells, natural killer (NK) cells, NK T cells, Cytotoxic T lymphocytes (CTLs), tumor infiltrating lymphocytes (TILs), lymphokine activated killer (LAK) cells, memory T cells, regulatory T cells (Tregs), helper T cells, cytokine-induced killer (CIK) cells, and any combination thereof. In other embodiments, immune stimulatory cells for ACT may be generated from embryonic stem cell (ESC) and induced pluripotent stem cell (iPSC). In some embodiments, autologous or allogeneic immune cells are used for ACT.

In some embodiments, cells used for ACT may be T cells engineered to express CARs comprising an antigen-binding domain specific to an antigen on tumor cells of interest. In other embodiments, cells used for ACT may be NK cells engineered to express CARs comprising an antigen-binding domain specific to an antigen on tumor cells of interest. In addition to adoptive transfer of genetically modified T cells (e.g., CAR T cells) for immunotherapy, alternate types of CAR-expressing leukocytes, either alone, or in combination with CAR T cells may be used for adoptive immunotherapy. In one example, a mixture of T cells and NK cells may be used for ACT. The expression level of CARs in T cells and NK cells, according to the present disclosure, is tuned and controlled by a small molecule that binds to the DD(s) operably linked to the CAR in the effector module.

In some embodiments, the CARs of the present disclosure may be placed under the transcriptional control of the T cell receptor alpha constant (TRAC) locus in the T cells to achieve uniform CAR expression while enhancing T cell potency. The TRAC locus may be disrupted using the CRISPR/Cas 9, zinc finger nucleases (ZFNs), TALENs followed by the insertion of the CAR construct. Methods of engineering CAR constructs directed to the TRAC locus are described in Eyquem J. et al (2017) Nature. 543(7643):113-117 (the contents of which are incorporated herein by reference in their entirety).

In some embodiments, NK cells engineered to express the present compositions may be used for ACT. NK cell activation induces perforin/granzyme-dependent apoptosis in target cells. NK cell activation also induces cytokine secretion such as IFN γ, TNF-α and GM-CSF. These cytokines enhance the phagocytic function of macrophages and their antimicrobial activity, and augment the adaptive immune response via up-regulation of antigen presentation by antigen presenting cells such as dendritic cells (DCs).

Other examples of genetic modification may include the introduction of chimeric antigen receptors (CARs) and the down-regulation of inhibitory NK cell receptors such as NKG2A.

NK cells may also be genetically reprogrammed to circumvent NK cell inhibitory signals upon interaction with tumor cells. For example, using CRISPR, ZFN, or TALEN to genetically modify NK cells to silence their inhibitory receptors may enhance the anti-tumor capacity of NK cells.

Immune cells can be isolated and expanded ex vivo using a variety of methods known in the art.

In some instances, sub populations of immune cells may be enriched for ACT. Methods for immune cell enrichment are taught in International Patent Publication NO. WO2015039100A1. In another example, T cells positive for B and T lymphocyte attenuator marker BTLA) may be used to enrich for T cells that are anti-cancer reactive as described in U.S. Pat. No. 9,512,401 (the content of each of which are incorporated herein by reference in their entirety).

In some embodiments, immune cells for ACT may be depleted of select sub populations to enhance T cell expansion. For example, immune cells may be depleted of Foxp3+ T lymphocytes to minimize the anti-tumor immune response using methods taught in US Patent Publication NO. US 20160298081A1; the contents of which are incorporated by reference herein in their entirety.

In some embodiments, activation and expansion of T cells for ACT is achieved antigenic stimulation of a transiently expressed Chimeric Antigen Receptor (CAR) on the cell surface. Such activation methods are taught in International Patent NO. WO2017015427, the content of which are incorporated herein by reference in their entirety.

In some embodiments, immune cells may be activated by antigens associated with antigen presenting cells (APCs). In some embodiments, the APCs may be dendritic cells, macrophages or B cells that antigen specific or nonspecific. The APCs may autologous or homologous in their organ. In some embodiments, the APCs may be artificial antigen presenting cells (aAPCs) such as cell based aAPCs or acellular aAPCs. Cell based aAPCs are may be selected from either genetically modified allogeneic cells such as human erythroleukemia cells or xenogeneic cells such as murine fibroblasts and *Drosophila* cells. Alternatively, the APCs maybe be acellular wherein the antigens or costimulatory domains are presented on synthetic surfaces such as latex beads, polystyrene beads, lipid vesicles or exosomes.

In some embodiments, cells of the disclosure, specifically T cells may be expanded using artificial cell platforms. In one embodiment, the mature T cells may be generated using artificial thymic organoids (ATOS) described by Seet C S et al. 2017. *Nat Methods*. 14, 521-530 (the contents of which are incorporated herein by reference in their entirety). ATOs are based on a stromal cell line expressing delta like canonical notch ligand (DLL1). In this method, stromal cells are aggregated with hematopoietic stem and progenitor cells by centrifugation and deployed on a cell culture insert at the air-fluid interface to generate organoid cultures. ATO-derived T cells exhibit naive phenotypes, a diverse T cell receptor (TCR) repertoire and TCR-dependent function.

In some embodiments, adoptive cell therapy is carried out by autologous transfer, wherein the cells are derived from a subject in need of a treatment and the cells, following isolation and processing are administered to the same subject. In other instances, ACT may involve allogenic transfer wherein the cells are isolated and/or prepared from a donor subject other than the recipient subject who ultimately receives cell therapy. The donor and recipient subject may be genetically identical, or similar or may express the same HLA class or subtype.

In some embodiments, the multiple immunotherapeutic agents introduced into the immune cells for ACT (e.g., T cells and NK cells) may be controlled by the same biocircuit system. In one example, a cytokine such as IL12 and a CAR construct such as CD19 CAR are linked to the same hDHFR destabilizing domain. The expression of IL12 and CD19 CAR is tuned using TMP simultaneously. In other embodiments, the multiple immunotherapeutic agents introduced into the immune cells for ACT (e.g., T cells and NK cells) may be controlled by different biocircuit systems. In one example, a cytokine such as IL12 and a CAR construct such as CD19 CAR are linked to different DDs in two separate effector modules, thereby can be tuned separately using different stimuli. In another example, a suicide gene and a CAR construct may be linked to two separate effector modules.

Following genetic modulation using SREs, biocircuits and compositions of the disclosure, cells are administered to the subject in need thereof. Methods for administration of cells for adoptive cell therapy are known and may be used in connection with the provided methods and compositions. For example, adoptive T cell therapy methods are described, e.g., in US Patent Application Publication No. 2003/0170238 to Gruenberg et al; U.S. Pat. No. 4,690,915 to Rosenberg; Rosenberg (2011) Nat Rev Clin Oncol. 8(10): 577-85). See, e.g., Themeli et al. (2013) Nat Biotechnol. 31(10): 928-933; Tsukahara et al. (2013) Biochem Biophys Res Commun 438(1): 84-9; Davila et al. (2013) PLoS ONE 8(4): e61338; the contents of each of which are incorporated herein by reference in their entirety.

In some embodiments, immune cells for ACT may be modified to express one or more immunotherapeutic agents which facilitate immune cells activation, infiltration, expansion, survival and anti-tumor functions. The immunotherapeutic agents may be a second CAR or TCR specific to a different target molecule; a cytokine or a cytokine receptor; a chimeric switch receptor that converts an inhibitory signal to a stimulatory signal; a homing receptor that guides adoptively transferred cells to a target site such as the tumor tissue; an agent that optimizes the metabolism of the immune cell; or a safety switch gene (e.g., a suicide gene) that kills activated T cells when a severe event is observed after adoptive cell transfer or when the transferred immune cells are no-longer needed.

In some embodiments, immune cells used for adoptive cell transfer can be genetically manipulated to improve their persistence, cytotoxicity, tumor targeting capacity, and ability to home to disease sites in vivo, with the overall aim of further improving upon their capacity to kill tumors in cancer patients. One example is to introduce effector modules of the disclosure comprising cytokines such as gamma-cytokines (IL2) into immune cells to promote immune cell proliferation and survival. Transduction of cytokine genes (e.g., gamma-cytokines IL2) into cells will be able to propagate immune cells without addition of exogenous cytokines and cytokine expressing NK cells have enhanced tumor cytotoxicity.

In some embodiments, biocircuits, their components, SREs or effector modules may be utilized to prevent T cell exhaustion. As used herein, "T cell exhaustion" refers to the stepwise and progressive loss of T cell function caused by chronic T cell activation. T cell exhaustion is a major factor limiting the efficacy of antiviral and antitumor immunotherapies. Exhausted T cells have low proliferative and cytokine producing capabilities concurrent with high rates of apoptosis and high surface expression of multiple inhibitory receptors. T cell activation leading to exhaustion may occur either in the presence or absence of the antigen.

In some embodiments, the biocircuits, and their components may be utilized to prevent T cell exhaustion in the context of Chimeric Antigen Receptor-T cell therapy (CAR-T). In this context, exhaustion in some instances, may be caused by the oligomerization of the scFvs of the CAR on the cell surface which leads to continuous activation of the intracellular domains of the CAR. As a non-limiting example, CARs of the present disclosure may include scFvs that are unable to oligomerize. As another non-limiting example, CARs that are rapidly internalized and re-expressed following antigen exposure may also be selected to prevent chronic scFv oligomerization on cell surface. In one embodiment, the framework region of the scFvs may be modified to prevent constitutive CAR signaling (Long et al. 2014. Cancer Research. 74(19) S1; the contents of which are incorporated by reference in their entirety). Tunable biocircuit systems of the present disclosure may also be used to regulate the surface expression of the CAR on the T cell surface to prevent chronic T cell activation. The CARs of the disclosure may also be engineered to minimize exhaustion. As a non-limiting example, the 41-BB signaling domain may be incorporated into CAR design to ameliorate T cell exhaustion. In some embodiments, any of the strategies disclosed by Long H A et al. may be utilized to prevent exhaustion (Long A H et al. (2015) Nature Medicine 21, 581-590; the contents of which are incorporated herein by reference in their entirety).

In some embodiments, the tunable nature of the biocircuits of the present disclosure may be utilized to reverse human T cell exhaustion observed with tonic CAR signaling. Reversibly silencing the biological activity of adoptively transferred cells using compositions of the present disclosure may be used to reverse tonic signaling which, in turn, may reinvigorate the T cells. Reversal of exhaustion may be measured by the downregulation of multiple inhibitory receptors associated with exhaustion.

In some embodiments, T cell metabolic pathways may be modified to diminish the susceptibility of T cells to exhaustion. Metabolic pathways may include, but are not limited to glycolysis, urea cycle, citric acid cycle, beta oxidation, fatty acid biosynthesis, pentose phosphate pathway, nucleotide biosynthesis, and glycogen metabolic pathways. As a non-limiting example, payloads that reduce the rate of glycolysis may be utilized to restrict or prevent T cell exhaustion (Long et al. Journal for Immunotherapy of Cancer 2013, 1(Suppl 1): P21; the contents of which are incorporated by reference in their entirety). In one embodiment, T cells of the present disclosure may be used in combination with inhibitors of glycolysis such as 2-deoxyglucose, and rapamycin.

In some embodiments, effector modules of the present disclosure, useful for immunotherapy may be placed under the transcriptional control of the T cell receptor alpha locus constant (TRAC) locus in the T cells. Eyquem et al. have shown that expression of the CAR from the TRAC locus prevents T cell exhaustion and the accelerated differentiation of T cells caused by excessive T cell activation (Eyquem J. et al (2017) Nature. 543(7643):113-117; the contents of which are incorporated herein by reference in their entirety).

In some embodiments, payloads of the disclosure may be used in conjunction with antibodies or fragments that target T cell surface markers associated with T cell exhaustion. T-cell surface markers associated with T cell exhaustion that may be used include, but are not limited to, CTLA-1, PD-1, TGIT, LAG-3, 2B4, BTLA, TIM3, VISTA, and CD96.

In one embodiment, the payload of the disclosure may be a CD276 CAR (with CD28, 4-1BB, and CD3 zeta intracellular domains), that does not show an upregulation of the markers associated with early T cell exhaustion (see International patent publication No. WO2017044699; the contents of which are incorporated by reference in their entirety).

In some embodiments, the compositions of the present disclosure may be utilized to alter TIL (tumor infiltrating lymphocyte) populations in a subject. In one embodiment, any of the payloads described herein may be utilized to change the ratio of CD4 positive cells to CD8 positive populations. In some embodiments, TILs may be sorted ex vivo and engineered to express any of the cytokines described herein. Payloads of the disclosure may be used to expand CD4 and/or CD8 populations of TILs to enhance TIL mediated immune response.

2. Cancer Vaccines

In some embodiments, biocircuits, effector modules, payloads of interest (immunotherapeutic agents), vectors, cells and compositions of the present disclosure may be used in conjunction with cancer vaccines.

3. Combination Treatments

In some embodiments, it is desirable to combine compositions, vectors and cells of the disclosure for administration to a subject. Compositions of the disclosure comprising different immunotherapeutic agents may be used in combination for enhancement of immunotherapy.

In some embodiments, it is desirable to combine compositions of the disclosure with adjuvants, that can enhance the potency and longevity of antigen-specific immune responses. Adjuvants used as immunostimulants in combination therapy include biological molecules or delivery carriers that deliver antigens. As non-limiting examples, the compositions of the disclosure may be combined with biological adjuvants such as cytokines, Toll Like Receptors, bacterial toxins, and/or saponins. In other embodiments, the compositions of the present disclosure may be combined with delivery carriers. Exemplary delivery carriers include, polymer microspheres, immune stimulating complexes, emulsions (oil-in-water or water-in-oil), aluminum salts, liposomes or virosomes.

In some embodiments, immune effector cells modified to express biocircuits, effector modules, DDs and payloads of the disclosure may be combined with the biological adjuvants described herein. Dual regulation of CAR and cytokines and ligands to segregate the kinetic control of target-mediated activation from intrinsic cell T cell expansion. Such dual regulation also minimizes the need for pre-conditioning regimens in patients. As a non-limiting example, DD regulated CAR e.g. CD19 CAR may be combined with cytokines e.g. IL12 to enhance the anti-tumor efficacy of the CAR (Pegram H. J., et al. Tumor-targeted T cells modified to secrete IL12 eradicate systemic tumors without need for prior conditioning. Blood. 2012; 119:4133-41; the contents of each of which are incorporated herein by reference in their entirety).

In some embodiments, immune effector cells modified to express one or more antigen-specific TCRs or CARs may be combined with compositions of the disclosure comprising immunotherapeutic agents that convert the immunosuppressive tumor microenvironment.

In one aspect, effector immune cells modified to express CARs specific to different target molecules on the same cell may be combined. In another aspect, different immune cells modified to express the same CAR construct such as NK cells and T cells may be used in combination for a tumor treatment, for instance, a T cell modified to express a CD19 CAR may be combined with a NK cell modified to express the same CD19 CAR to treat B cell malignancy.

In other embodiments, immune cells modified to express CARs may be combined with checkpoint blockade agents.

In some embodiments, immune effector cells modified to expressed biocircuits, effector modules, DDs and payloads of the disclosure may be combined with cancer vaccines of the disclosure.

In some embodiments, methods of the disclosure may include combination of the compositions of the disclosure with other agents effective in the treatment of cancers, infection diseases and other immunodeficient disorders, such as anti-cancer agents. As used herein, the term "anti-cancer agent" refers to any agent which is capable of negatively affecting cancer in a subject, for example, by killing cancer cells, inducing apoptosis in cancer cells, reducing the growth rate of cancer cells, reducing the incidence or number of metastases, reducing tumor size, inhibiting tumor growth, reducing the blood supply to a tumor or cancer cells, promoting an immune response against cancer cells or a tumor, preventing or inhibiting the progression of cancer, or increasing the lifespan of a subject with cancer.

In some embodiments, anti-cancer agent or therapy may be a chemotherapeutic agent, or radiotherapy, immunotherapeutic agent, surgery, or any other therapeutic agent which, in combination with the present disclosure, improves the therapeutic efficacy of treatment.

In some embodiments, compositions of the present disclosure may be used in combination with immunotherapeutics other than the inventive therapy described herein, such as antibodies specific to some target molecules on the surface of a tumor cell.

Exemplary chemotherapies include, without limitation, Acivicin; Aclarubicin; Acodazole hydrochloride; Acronine; Adozelesin; Aldesleukin; Altretamine; Ambomycin; Ametantrone acetate; Amsacrine; Anastrozole; Anthramycin; Asparaginase; Asperrin, Sulindac, Curcumin, alkylating agents including: Nitrogen mustards such as mechlorethamine, cyclophosphamide, ifosfamide, melphalan and chlorambucil; nitrosoureas such as carmustine (BC U), lomustine (CCNU), and semustine (methyl-CC U); thylenimines/methylmelamine such as thriethylenemelamine (TEM), triethylene, thiophosphoramide (thiotepa), hexamethylmelamine (HMM, altretamine); alkyl sulfonates such as busulfan; triazines such as dacarbazine (DTIC); antimetabolites including folic acid analogs such as methotrexate and trimetrexate, pyrrolidine analogs such as 5-fluorouracil, fluorodeoxyuridine, gemcitabine, cytosine arabinoside (AraC, cytarabine), 5-azacytidine, 2,2'-difluorodeoxycytidine, purine analogs such as 6-mercaptopurine, 6-thioguanine, azathioprine, 2'-deoxycoformycin (pentostatin), erythrohydroxynonyladenine (EHNA), fludarabine phosphate, and 2-chlorodeoxyadenosine (cladribine, 2-CdA); natural products including antimitotic drugs such as paclitaxel, vinca alkaloids including vinblastine (VLB), vincristine, and vinorelbine, taxotere, estramustine, and estramustine phosphate; epipodophylotoxins such as etoposide and teniposide; antibiotics, such as actimomycin D, daunomycin (rubidomycin), doxorubicin, mitoxantrone, idarubicin, bleomycins, plicamycin (mithramycin), mitomycinC, and actinomycin; enzymes such as L-asparaginase, cytokines such as interferon (IFN)-gamma, tumor necrosis factor (TNF)-alpha, TNF-beta and GM-CSF, anti-angiogenic factors, such as angiostatin and endostatin, inhibitors of FGF or VEGF such as soluble forms of receptors for angiogenic factors, including soluble VGF/VEGF receptors, platinum coordination complexes such as cisplatin and carboplatin, anthracenediones such as mitoxantrone, substituted urea such as hydroxyurea, methylhydrazine derivatives including N-methylhydrazine (MIFf) and procarbazine, adrenocortical suppressants such as mitotane (o,p'-DDD) and aminoglutethimide; hormones and antagonists including adrenocorticosteroid antagonists such as prednisone and equivalents, dexamethasone and aminoglutethimide; progestin such as hydroxyprogesterone caproate, medroxyprogesterone acetate and megestrol acetate; estrogen such as diethylstilbestrol and ethinyl estradiol equivalents; antiestrogen such as tamoxifen; androgens including testosterone propionate and fluoxymesterone/equivalents; antiandrogens such as flutamide, gonadotropin-releasing hormone analogs and leuprolide; non-steroidal antiandrogens such as flutamide; kinase inhibitors, histone deacetylase inhibitors, methylation inhibitors, proteasome inhibitors, monoclonal antibodies, oxidants, anti-oxidants, telomerase inhibitors, BH3 mimetics, ubiquitin ligase inhibitors, stat inhibitors and receptor tyrosin kinase inhibitors such as imatinib mesylate (marketed as Gleevac or Glivac) and erlotinib (an EGF receptor inhibitor) now marketed as Tarveca; anti-virals such as oseltamivir phosphate, Amphotericin B, and palivizumab; Sdi 1 mimetics; Semustine; Senescence derived inhibitor 1; Sparfosic acid; Spicamycin D; Spiromustine; Splenopentin; Spongistatin 1; Squalamine; Stipiamide; Stromelysin inhibitors; Sulfinosine; Superactive vasoactive intestinal peptide antagonist; Velaresol; Veramine; Verdins; Verteporfin; Vinorelbine; Vinxaltine; Vitaxin; Vorozole; Zanoterone; Zeniplatin; Zilascorb; and Zinostatin stimalamer; PI3Kβ small-molecule inhibitor, GSK2636771; pan-PI3K inhibitor (BKM120); BRAF inhibitors. Vemurafenib (Zelboraf) and dabrafenib (Tafinlar); or any analog or derivative and variant of the foregoing.

Radiotherapeutic agents and factors include radiation and waves that induce DNA damage for example, γ-irradiation, X-rays, UV-irradiation, microwaves, electronic emissions, radioisotopes, and the like. Therapy may be achieved by irradiating the localized tumor site with the above described forms of radiations. It is most likely that all of these factors effect a broad range of damage DNA, on the precursors of DNA, the replication and repair of DNA, and the assembly and maintenance of chromosomes.

In some embodiments, the chemotherapeutic agent may be an immunomodulatory agent such as lenalidomide (LEN). Recent studies have demonstrated that lenalidomide can enhance antitumor functions of CAR modified T cells (Otahal et al., *Oncoimmunology,* 2015, 5(4): e1115940). Some examples of anti-tumor antibodies include tocilizumab, siltuximab.

Other agents may be used in combination with compositions of the disclosure may also include, but not limited to, agents that affect the upregulation of cell surface receptors and their ligands such as Fas/Fas ligand, DR4 or DR5/TRAIL and GAP junctions, cytostatic and differentiation agents, inhibitors of cell adhesion such as focal adhesion kinase (FAKs) inhibitors and Lovastatin, or agents that increase the sensitivity of the hyper proliferative cells to apoptotic inducers such as the antibody C225.

The combinations may include administering the compositions of the disclosure and other agents at the same time or separately. Alternatively, the present immunotherapy may precede or follow the other agent/therapy by intervals ranging from minutes, days, weeks to months.

4. Diseases

Provided in the present disclosure is a method of reducing a tumor volume or burden in a subject in need, the method comprising introducing into the subject a composition of the disclosure.

The present disclosure also provides methods for treating a cancer in a subject, comprising administering to the subject an effective amount of an immune effector cell genetically modified to express at least one effector module of the disclosure.

Cancer

Various cancers may be treated with pharmaceutical compositions, biocircuits, biocircuit components, effector modules including their SREs or payloads of the present disclosure. As used herein, the term "cancer" refers to any of various malignant neoplasms characterized by the proliferation of anaplastic cells that tend to invade surrounding tissue and metastasize to new body sites and also refers to the pathological condition characterized by such malignant neoplastic growths. Cancers may be tumors or hematological malignancies, and include but are not limited to, all types of lymphomas/leukemias, carcinomas and sarcomas, such as those cancers or tumors found in the anus, bladder, bile duct, bone, brain, breast, cervix, colon/rectum, endometrium, esophagus, eye, gallbladder, head and neck, liver, kidney, larynx, lung, mediastinum (chest), mouth, ovaries, pancreas, penis, prostate, skin, small intestine, stomach, spinal marrow, tailbone, testicles, thyroid and uterus.

Types of carcinomas which may be treated with the compositions of the present disclosure include, but are not limited to, papilloma/carcinoma, choriocarcinoma, endodermal sinus tumor, teratoma, adenoma/adenocarcinoma, melanoma, fibroma, lipoma, leiomyoma, rhabdomyoma, mesothelioma, angioma, osteoma, chondroma, glioma, lymphoma/leukemia, squamous cell carcinoma, small cell carcinoma, large cell undifferentiated carcinomas, basal cell carcinoma and sinonasal undifferentiated carcinoma.

Types of carcinomas which may be treated with the compositions of the present disclosure include, but are not limited to, soft tissue sarcoma such as alveolar soft part sarcoma, angiosarcoma, dermatofibrosarcoma, desmoid tumor, desmoplastic small round cell tumor, extraskeletal chondrosarcoma, extraskeletal osteosarcoma, fibrosarcoma, hemangiopericytoma, hemangiosarcoma, Kaposi's sarcoma, leiomyosarcoma, liposarcoma, lymphangiosarcoma, lymphosarcoma, malignant fibrous histiocytoma, neurofibrosarcoma, rhabdomyosarcoma, synovial sarcoma, and Askin's tumor, Ewing's sarcoma (primitive neuroectodermal tumor), malignant hemangioendothelioma, malignant schwannoma, osteosarcoma, and chondrosarcoma.

As a non-limiting example, the carcinoma which may be treated may be Acute granulocytic leukemia, Acute lymphocytic leukemia, Acute myelogenous leukemia, Adenocarcinoma, Adenosarcoma, Adrenal cancer, Adrenocortical carcinoma, Anal cancer, Anaplastic astrocytoma, Angiosarcoma, Appendix cancer, Astrocytoma, Basal cell carcinoma, B-Cell lymphoma), Bile duct cancer, Bladder cancer, Bone cancer, Bowel cancer, Brain cancer, Brain stem glioma, Brain tumor, Breast cancer, Carcinoid tumors, Cervical cancer, Cholangiocarcinoma, Chondrosarcoma, Chronic lymphocytic leukemia, Chronic myelogenous leukemia, Colon cancer, Colorectal cancer, Craniopharyngioma, Cutaneous lymphoma, Cutaneous melanoma, Diffuse astrocytoma, Ductal carcinoma in situ, Endometrial cancer, Ependymoma, Epithelioid sarcoma, Esophageal cancer, Ewing sarcoma, Extrahepatic bile duct cancer, Eye cancer, Fallopian tube cancer, Fibrosarcoma, Gallbladder cancer, Gastric cancer, Gastrointestinal cancer, Gastrointestinal carcinoid cancer, Gastrointestinal stromal tumors, General, Germ cell tumor, Glioblastoma multiforme, Glioma, Hairy cell leukemia, Head and neck cancer, Hemangioendothelioma, Hodgkin lymphoma, Hodgkin's disease, Hodgkin's lymphoma, Hypopharyngeal cancer, Infiltrating ductal carcinoma, Infiltrating lobular carcinoma, Inflammatory breast cancer, Intestinal Cancer, Intrahepatic bile duct cancer, Invasive/infiltrating breast cancer, Islet cell cancer, Jaw cancer, Kaposi sarcoma, Kidney cancer, Laryngeal cancer, Leiomyosarcoma, Leptomeningeal metastases, Leukemia, Lip cancer, Liposarcoma, Liver cancer, Lobular carcinoma in situ, Low-grade astrocytoma, Lung cancer, Lymph node cancer, Lymphoma, Male breast cancer, Medullary carcinoma, Medulloblastoma, Melanoma, Meningioma, Merkel cell carcinoma, Mesenchymal chondrosarcoma, Mesenchymous, Mesothelioma, Metastatic breast cancer, Metastatic melanoma, Metastatic squamous neck cancer, Mixed gliomas, Mouth cancer, Mucinous carcinoma, Mucosal melanoma, Multiple myeloma, Nasal cavity cancer, Nasopharyngeal cancer, Neck cancer, Neuroblastoma, Neuroendocrine tumors, Non-Hodgkin lymphoma, Non-Hodgkin's lymphoma, Non-small cell lung cancer, Oat cell cancer, Ocular cancer, Ocular melanoma, Oligodendroglioma, Oral cancer, Oral cavity cancer, Oropharyngeal cancer, Osteogenic sarcoma, Osteosarcoma, Ovarian cancer, Ovarian epithelial cancer, Ovarian germ cell tumor, Ovarian primary peritoneal carcinoma, Ovarian sex cord stromal tumor, Paget's disease, Pancreatic cancer, Papillary carcinoma, Paranasal sinus cancer, Parathyroid cancer, Pelvic cancer, Penile cancer, Peripheral nerve cancer, Peritoneal cancer, Pharyngeal cancer, Pheochromocytoma, Pilocytic astrocytoma, Pineal region tumor, Pineoblastoma, Pituitary gland cancer, Primary central nervous system lymphoma, Prostate cancer, Rectal cancer, Renal cell cancer, Renal pelvis cancer, Rhabdomyosarcoma, Salivary gland cancer, Sarcoma, Sarcoma, bone, Sarcoma, soft tissue, Sarcoma, uterine, Sinus cancer, Skin cancer, Small cell lung cancer, Small intestine cancer, Soft tissue sarcoma, Spinal cancer, Spinal column cancer, Spinal cord cancer, Spinal tumor, Squamous cell carcinoma, Stomach cancer, Synovial sarcoma, T-cell lymphoma), Testicular cancer, Throat cancer, Thymoma/thymic carcinoma, Thyroid cancer, Tongue cancer, Tonsil cancer, Transitional cell cancer, Transitional cell cancer, Transitional cell cancer, Triple-negative breast cancer, Tubal cancer, Tubular carcinoma, Ureteral cancer, Ureteral cancer, Urethral cancer, Uterine adenocarcinoma, Uterine cancer, Uterine sarcoma, Vaginal cancer, and Vulvar cancer.

Infectious Diseases

In some embodiment, biocircuits of the disclosure may be used for the treatment of infectious diseases. Biocircuits of the disclosure may be introduced in cells suitable for adoptive cell transfer such as macrophages, dendritic cells, natural killer cells, and or T cells. Infectious diseases treated by the biocircuits of the disclosure may be diseases caused by viruses, bacteria, fungi, and/or parasites.

"Infection diseases" herein refer to diseases caused by any pathogen or agent that infects mammalian cells, preferably human cells and causes a disease condition. Examples thereof include bacteria, yeast, fungi, protozoans, mycoplasma, viruses, prions, and parasites. Examples include those involved in (a) viral diseases such as, for example, diseases resulting from infection by an adenovirus, a herpesvirus (e.g., HSV-I, HSV-II, CMV, or VZV), a poxvirus (e-g-, an orthopoxvirus such as variola or vaccinia, or molluscum contagiosum), a picornavirus (e.g., rhinovirus or enterovirus), an orthomyxovirus (e.g., influenzavirus), a paramyxovirus (e.g., parainfluenza virus, mumps virus, measles virus, and respiratory syncytial virus (RSV)), a coronavirus (e.g., SARS), a papovavirus (e.g., papillomaviruses, such as those that cause genital warts, common warts, or plantar warts), a hepadnavirus (e.g., hepatitis B virus), a flavivirus (e.g., hepatitis C virus or Dengue virus), or a retrovirus (e.g., a lentivirus such as HIV); (b) bacterial diseases such as, for example, diseases resulting from infection by bacteria of, for example, the genus *Escherichia, Enterobacter, Salmonella, Staphylococcus, Shigella, Listeria, Aerobacter, Helicobacter, Klebsiella, Proteus, Pseudomonas, Streptococcus, Chlamydia, Mycoplasma, Pneumococcus, Neisseria, Clostridium, Bacillus, Corynebacterium, Mycobacterium, Campylobacter, Vibrio, Serratia, Providencia, Chromobacterium, Brucella, Yersinia, Haemophilus,* or *Bordetella*; (c) other infectious diseases, such *chlamydia,* fungal diseases including but not limited to candidiasis, aspergillosis, histoplasmosis, cryptococcal meningitis, parasitic diseases including but not limited to malaria, *Pneumocystis carnii* pneumonia, leishmaniasis, cryptosporidiosis, toxoplasmosis, and trypanosome infection and prions that cause human disease such as Creutzfeldt-Jakob Disease (CJD), variant Creutzfeldt-Jakob Disease (vCJD), Gerstmann-Sträussler-Scheinker syndrome, Fatal Familial Insomnia and kuru.

Combination Treatments

The disclosure further relates to the use of pharmaceutical compositions, biocircuits, biocircuit components, effector modules including their SREs or payloads of the present disclosure for treating one or more forms of cancer, in combination with other pharmaceuticals and/or other therapeutic methods, e.g., with known pharmaceuticals and/or known therapeutic methods, such as, for example, those which are currently employed for treating these disorders. For example, the pharmaceutical compositions, biocircuits, biocircuit components, effector modules including their SREs or payloads of the present disclosure can also be administered in conjunction with one or more additional anti-cancer treatments, such as biological, chemotherapy and radiotherapy. Accordingly, a treatment can include, for example, imatinib (Gleevac), all-trans-retinoic acid, a monoclonal antibody treatment (gemtuzumab, ozogamicin), chemotherapy (for example, chlorambucil, prednisone, prednisolone, vincristine, cytarabine, clofarabine, farnesyl transferase inhibitors, decitabine, inhibitors of MDR1), rituximab, interferon-α, anthracycline drugs (such as daunorubicin or idarubicin), L-asparaginase, doxorubicin, cyclophosphamide, doxorubicin, bleomycin, fludarabine, etoposide, pentostatin, or cladribine), bone marrow transplant, stem cell transplant, radiation therapy, anti-metabolite drugs (methotrexate and 6-mercaptopurine), or any of the antibodies taught in Table 5 of International Publication No. WO2017/180587 (the contents of which are herein incorporated by reference in their entirety) or combinations thereof.

Immuno-Oncology and Cell Therapies

Recent progress in the field of cancer immunology has allowed the development of several approaches to help the immune system keep the cancer at bay. Such immunotherapy approaches include the targeting of cancer antigens through monoclonal antibodies or through adoptive transfer of ex vivo engineered T cells (e.g., which contain chimeric antigen receptors or engineered T cell receptors).

In some embodiments, pharmaceutical compositions, biocircuits, biocircuit components, effector modules including their SREs or payloads of the present disclosure may be used in the modulation or alteration or exploitation of the immune system to target one or more cancers. This approach may also be considered with other such biological approaches, e.g., immune response modifying therapies such as the administration of interferons, interleukins, colony-stimulating factors, other monoclonal antibodies, vaccines, gene therapy, and nonspecific immunomodulating agents are also envisioned as anti-cancer therapies to be combined with the pharmaceutical compositions, biocircuits, biocircuit components, effector modules including their SREs or payloads of the present disclosure.

Cancer immunotherapy refers to a diverse set of therapeutic strategies designed to induce the patient's own immune system to fight the cancer. In some embodiments, pharmaceutical compositions, biocircuits, biocircuit components, effector modules including their SREs or payloads of the present disclosure are designed as immune-oncology therapeutics.

Cell Therapies

There are several types of cellular immunotherapies, including tumor infiltrating lymphocyte (TIL) therapy, genetically engineered T cells bearing chimeric antigen receptors (CARs), and recombinant TCR technology.

According to the present disclosure, the biocircuits and systems may be used in the development and implementation of cell therapies such as adoptive cell therapy. The biocircuits, their components, effector modules and their SREs and payloads may be used in cell therapies to effect TCR removal—TCR gene disruption, TCR engineering, to regulate epitope tagged receptors, in APC platforms for stimulating T cells, as a tool to enhance ex vivo APC stimulation, to improve methods of T cell expansion, in ex vivo stimulation with antigen, in TCR/CAR combinations, in the manipulation or regulation of TILs, in allogeneic cell therapy, in combination T cell therapy with other treatment lines (e.g. radiation, cytokines), to encode engineered TCRs, or modified TCRs, or to enhance T cells other than TCRs (e.g., by introducing cytokine genes, genes for the checkpoint inhibitors PD1, CTLA4).

In some embodiments, improved response rates are obtained in support of cell therapies.

Expansion and persistence of cell populations may be achieved through regulation or fine tuning of the payloads, e.g., the receptors or pathway components in T cells, NK cells or other immune-related cells. In some embodiments, biocircuits, their components, SREs or effector modules are designed to spatially and/or temporally control the expression of proteins which enhance T-cell or NK cell response. In some embodiments, biocircuits, their components, SREs or effector modules are designed to spatially and/or temporally control the expression of proteins which inhibit T-cell or NK cell response.

In some embodiments, biocircuits, their components, SREs or effector modules are designed to reshape the tumor microenvironment to extend utility of the biocircuit or a pharmaceutical composition beyond direct cell killing.

In some embodiments, biocircuits, their components, SREs or effector modules are designed to reduce, mitigate or eliminate the CAR cytokine storm. In some embodiments, such reduction, mitigation and/or elimination occurs in solid tumors or tumor microenvironments.

In some embodiments, the effector modules may encode one or more cytokines.

In one embodiment, the payload of the disclosure may comprise IL2. In one aspect, the effector module of the disclosure may be DD-IL2 fusion polypeptide.

In one aspect, the effector module of the disclosure may be a DD-IL12 fusion polypeptide. Regulatable DD-IL12 fusion polypeptide may be directly used as an immunotherapeutic agent or be transduced into an immune effector cell (T cells and TIL cells) to generate modified T cells with greater in vivo expansion and survival capabilities for adoptive cell transfer. The need for harsh preconditioning regimens in current adoptive cell therapies may be minimized using regulated IL12. DD-IL12 may be utilized to modify tumor microenvironment and increase persistence in solid tumors that are currently refractory to tumor antigen targeted therapy. In some embodiments, CAR expressing T cells may be armored with DD regulated IL12 to relieve immunosuppression without systemic toxicity.

In some embodiments, the IL12 may be a Flexi IL12, wherein both p35 and p40 subunits, are encoded by a single cDNA that produces a single chain polypeptide.

In some embodiments, effector modules may encode, or be tuned or induced to produce, one or more cytokines for expansion of cells in the biocircuits of the disclosure. In such cases the cells may be tested for actual expansion. Expansion may be at least 5%, 10%, 20%, 30%, 40%, 50%, 60%, 70%, 80%, 90% or more. In some embodiments, the cytokine is IL-15. Effector modules encoding IL-15 may be designed to induce proliferation in cytotoxic populations and avoid stimulation of T regs. In other cases, the effector modules which induce proliferation in cytotoxic populations may also stimulate NK and NKT cells. Interleukin 15 is a potent immune stimulatory cytokine and an essential survival factor for T cells, and Natural Killer cells.

In some embodiments, the tumor microenvironment may be remodeled using a biocircuit containing an effector module encoding IL17.

The immune system can be harnessed for the treatment of diseases beyond cancer. Biocircuits, their components, SREs or effector modules may be utilized in immunotherapy for the treatment of diseases including, but not limited to, autoimmune diseases, allergies, graft versus host disease, and diseases and disorders that may result in immunodeficiency such as acquired immune deficiency syndrome (AIDS).

In some embodiments, payloads of the present disclosure may be a chimeric antigen receptor (CAR), which when transduced into immune cells (e.g., T cells and NK cells), can re-direct the immune cells against the target (e.g., a tumor cell) which expresses a molecule recognized by the extracellular target moiety of the CAR.

In some embodiments, the targeting moiety of a CAR construct may be a natural ligand of the target molecule, or a variant and/or fragment thereof capable of binding the target molecule. In some aspects, the targeting moiety of a CAR may be a receptor of the target molecule, for example, a full length human CD27, as a CD70 receptor, may be fused in frame to the signaling domain of CD3 forming a CD27 chimeric receptor as an immunotherapeutic agent for CD70-positive malignancies (see, e.g., US patent publication NO.: US20130323214; the contents of which are incorporated by reference herein in their entirety).

In some embodiments, the targeting moiety of a CAR may recognize a tumor specific antigen (TSA), for example a cancer neoantigen whose expression is restricted to tumor cells.

As non-limiting examples, the CAR of the present disclosure may comprise the extracellular targeting domain capable of binding to a tumor specific antigen selected from 5T4, 707-AP, A33, AFP (α-fetoprotein), AKAP-4 (A kinase anchor protein 4), ALK, α5β1-integrin, androgen receptor, annexin II, alpha-actinin-4, ART-4, B1, B7H3, B7H4, BAGE (B melanoma antigen), BCMA, BCR-ABL fusion protein, beta-catenin, BKT-antigen, BTAA, CA-I (carbonic anhydrase I), CA50 (cancer antigen 50), CA125, CA15-3, CA195, CA242, calretinin, CAIX (carbonic anhydrase), CAMEL (cytotoxic T-lymphocyte recognized antigen on melanoma), CAM43, CAP-1, Caspase-8/m, CD4, CD5, CD7, CD19, CD20, CD22, CD23, CD25, CD27/m, CD28, CD30, CD33, CD34, CD36, CD38, CD40/CD154, CD41, CD44v6, CD44v7/8, CD45, CD49f, CD56, CD68\KP1, CD74, CD79a/CD79b, CD103, CD123, CD133, CD138, CD171, cdc27/m, CDK4 (cyclin dependent kinase 4), CDKN2A, CDS, CEA (carcinoembryonic antigen), CEACAM5, CEACAM6, chromogranin, c-Met, c-Myc, coa-1, CSAp, CT7, CT10, cyclophilin B, cyclin B1, cytoplasmic tyrosine kinases, cytokeratin, DAM-10, DAM-6, dek-can fusion protein, desmin, DEPDC1 (DEP domain containing 1), E2A-PRL, EBNA, EGF-R (epidermal growth factor receptor), EGP-1(epithelial glycoprotein-1) (TROP-2), EGP-2, EGP-40, EGFR (epidermal growth factor receptor), EGFRvIII, EF-2, ELF2M, EMMPRIN, EpCAM (epithelial cell adhesion molecule), EphA2, Epstein Barr virus antigens, Erb (ErbB1; ErbB3; ErbB4), ETA (epithelial tumor antigen), ETV6-AML1 fusion protein, FAP (fibroblast activation protein), FBP (folate-binding protein), FGF-5, folate receptor a, FOS related antigen 1, fucosyl GM1, G250, GAGE (GAGE-1; GAGE-2), galactin, GD2 (ganglioside), GD3, GFAP (glial fibrillary acidic protein), GM2 (oncofetal antigen-immunogenic-1; OFA-I-1), GnT-V, Gp100, H4-RET, HAGE (helicase antigen), HER-2/neu, HIFs (hypoxia inducible factors), HIF-1α, HIF-2α, HLA-A2, HLA-A*0201-R170I, HLA-A11, HMWMAA, Hom/Mel-40, HSP70-2M (Heat shock protein 70), HST-2, HTgp-175, hTERT (or hTRT), human papillomavirus-E6/human papillomavirus-E7 and E6, iCE (immune-capture EIA), IGF-1R, IGH-IGK, IL-2R, IL-5, ILK (integrin-linked kinase), IMP3 (insulin-like growth factor II mRNA-binding protein 3), IRF4 (interferon regulatory factor 4), KDR (kinase insert domain receptor), KIAA0205, KRAB-zinc finger protein (KID)-3; KID31, KSA (17-1A), K-ras, LAGE, LCK, LDLR/FUT (LDLR-fucosyltransferaseAS fusion protein), LeY (Lewis Y), MAD-CT-1, MAGE (tyrosinase, melanoma-associated antigen) (MAGE-1; MAGE-3), melan-A tumor antigen (MART), MART-2/Ski, MC1R (melanocortin 1 receptor), MDM2, mesothelin, MPHOSPH1, MSA (muscle-specific actin), mTOR (mammalian targets of rapamycin), MUC-1, MUC-2, MUM-1 (melanoma associated antigen (mutated) 1), MUM-2, MUM-3, Myosin/m, MYL-RAR, NA88-A, N-acetylglucosaminyltransferase, neo-PAP, NF-KB (nuclear factor-kappa B), neurofilament, NSE (neuron-specific enolase), Notch receptors, NuMa, N-Ras, NY-BR-1, NY-CO-1, NY-ESO-1, Oncostatin M, OS-9, OY-TES1, p53 mutants, p190 minor bcr-abl, p15(58), p185erbB2, pl80erbB-3, PAGE (prostate associated gene), PAP (prostatic acid phosphatase), PAX3, PAX5, PDGFR (platelet derived growth factor receptor), cytochrome P450 involved in piperidine and pyrrolidine utilization (PIPA), Pml-RAR alpha fusion protein, PR-3 (proteinase 3), PSA (prostate specific antigen), PSM, PSMA (Prostate stem cell antigen), PRAME (preferentially expressed antigen of melanoma), PTPRK, RAGE (renal tumor antigen), Raf (A-Raf, B-Raf and C-Raf), Ras, receptor tyrosine kinases, RCAS1, RGSS, ROR1 (receptor tyrosine kinase-like orphan receptor 1), RU1, RU2, SAGE, SART-1, SART-3, SCP-1, SDCCAG16, SP-17 (sperm protein 17), src-family, SSX (synovial sarcoma X breakpoint)-1, SSX-2(HOM-MEL-40), SSX-3, SSX-4, SSX-5, STAT-3, STAT-5, STAT-6, STEAD, STn, survivin, syk-ZAP70, TA-90 (Mac-2 binding protein\cyclophilin C-associated protein), TAAL6, TAC-STD1 (tumor associated calcium signal transducer 1), TAC-STD2, TAG-72-4, TAGE, TARP (T cell receptor gamma alternate reading frame protein), TEL/AML1 fusion protein, TEM1, TEM8 (endosialin or CD248), TGFβ, TIE2, TLP, TMPRSS2 ETS fusion gene, TNF-receptor (TNF-α receptor, TNF-β receptor; or TNF-γ receptor), transferrin receptor, TPS, TRP-1 (tyrosine related protein 1), TRP-2, TRP-2/INT2, TSP-180, VEGF receptor, WNT, WT-1 (Wilm's tumor antigen) and XAGE.

As non-limiting examples, the targeting moiety of the present disclosure may be a scFv antibody that recognizes a tumor specific antigen (TSA), for example scFvs of antibodies SS, SS1 and HN1 that specifically recognize and bind to human mesothelin (U.S. Pat. No. 9,359,447), scFv of antibody of GD2 (U.S. Pat. No. 9,315,585), a CD19 antigen binding domain (U.S. Pat. No. 9,328,156); a NKG2D ligand binding domain (U.S. Pat. No. 9,273,283; US patent publication NO.: US20160311906A1); human anti-mesothelin scFvs comprising the amino acid sequences of SEQ ID NO: 11 and 12 of U.S. Pat. No. 9,272,002, an anti-CS1 binding agent (US patent publication NO.: US20160075784); an anti-BCMA binding domain (International Patent Publication NO.: WO2016/014565); anti-CD19 scFv antibody of SEQ ID NO.: 20 in U.S. Pat. No. 9,102,761; GFR alpha 4 antigen binding fragments having the amino acid sequences of SEQ ID NOs.: 59 and 79 of International patent publication NO.: 2016/025880; anti-CLL-1 (C-type lectin-like molecule 1) binding domains having the amino acid sequences of SEQ ID NO.:47, 44, 48, 49, 50, 39, 40, 41, 42, 43, 45, 46, 51, 73, 70, 74, 75, 76, 65, 66, 67, 68, 69, 71, 72, 77, 195, 86, 83, 87, 88, 89, 78, 79, 80, 81, 82, 84, 85, 90 and 196 of International Patent Publication NO.: WO2016014535); CD33 binding domains having the amino acid sequences of SEQ ID NOs.: 39-46 of International patent publication NO.: WO2016014576; a GPC3 (glypican-3) binding domain (SEQ ID NO.: 2 and SEQ ID NO.: 4 of International patent publication NO.: WO2016036973); a GFR alpha4 (Glycosyl-phosphatidylinositol (GPI)-linked GDNF family α-receptor 4 cell-surface receptor) binding domain (International Patent Publication NO.: WO2016025880); CD123 binding domains having the amino acid sequences of SEQ ID NOs.: 480, 483, 485, 478, 158, 159, 160, 157, 217, 218, 219, 216, 276, 277, 278, and 275 of International patent publication NO.: WO20160258896; an anti-ROR1 antibody or fragments thereof (International patent publication NO.: WO2016016344); scFvs specific to GPC-3 (SEQ ID NOs.: 1 and 24 of International patent publication NO.: WO2016049459); scFv for CSPG4 (SEQ ID NO.: 2 of International patent publication NO.: WO2015080981; scFv for folate receptor alpha (US Patent Publication NO.: US20170002072A1); the contents of each of which are incorporated herein by reference in their entirety.

In one embodiment of the present disclosure, the CAR of the present disclosure is a CD19 specific CAR. In the context of the disclosure, an effector module may comprise an ecDHFR DD or FKBP DD operably linked to a CD19 CAR fusion construct.

In one embodiment, the payload of the disclosure may be a TCR specific for the NY-ESO-1 and LAGE-1 cancer testis antigens (NY-ESO$^{c259}$-T) that induces robust effector and memory T cells' expansion without inducing T cell exhaustion (See Melchiori et al. (2015) Molecular Therapy, Supl, pS204-5205. (the contents of which are incorporated herein by reference in their entirety).

In some embodiments, pharmaceutical compositions, biocircuits, biocircuit components, effector modules including their SREs or payloads of the present disclosure may be used in the modulation or alteration or exploitation of the immune system to target one or more self-reactive immune components such as auto antibodies and self-reactive immune cells to attenuate autoimmune diseases. In some embodiments, the SREs of the present disclosure may be utilized in regulating or tuning the Chimeric Auto Antibody Receptor (CAAR) based T cell therapy in order to optimize its utility in the treatment of autoimmune diseases (Ellebrecht C. T. et al., Science. 2016 Jul. 8; 353(6295):179-84; the contents of which are incorporated herein by reference in their entirety). In some embodiments, biocircuits, their components, SREs or effector modules are designed to modulate Tregs to attenuate autoimmune disorders. In such a case, IL-2 may be regulated using a singly tuned module or one having multiple tuned features as described herein.

In some embodiments, biocircuits, their components, SREs or effector modules may be utilized in immunotherapy-based treatments to attenuate or mitigate Graft vs. Host disease (GVHD). GVHD refers to a condition following stem cell or bone marrow transplant where in the allogeneic donor immune cells react against host tissue. In some embodiments, biocircuits, their components, SREs or effector modules are designed to modulate Tregs for the treatment of GVHD. In one embodiment, biocircuits containing an effector module encoding TNF-alpha may be used to modulate Tregs to minimize GVHD (Pierini, A. et al., Blood. 2016 Aug. 11; 128(6):866-71; the contents of which are incorporated herein by reference in their entirety).

In some embodiments, biocircuits, their components, SREs or effector modules are designed to be significantly less immunogenic than other biocircuits or switches in the art.

As used herein, "significantly less immunogenic" refers to a detectable decrease in immunogenicity. In another embodiment, the term refers to a fold decrease in immunogenicity. In another embodiment, the term refers to a decrease such that an effective amount of the biocircuits, their components, SREs or effector modules which can be administered without triggering a detectable immune response. In another embodiment, the term refers to a decrease such that the biocircuits, their components, SREs or effector modules can be repeatedly administered without eliciting an immune response. In another embodiment, the decrease is such that the biocircuits, their components, SREs or effector modules can be repeatedly administered without eliciting an immune response.

In another embodiment, the biocircuits, their components, SREs or effector modules is 2-fold less immunogenic than its unmodified counterpart or reference compound. In another embodiment, immunogenicity is reduced by a 3-fold factor. In another embodiment, immunogenicity is reduced by a 5-fold factor. In another embodiment, immunogenicity is reduced by a 7-fold factor. In another embodiment, immunogenicity is reduced by a 10-fold factor. In another embodiment, immunogenicity is reduced by a 15-fold factor. In another embodiment, immunogenicity is reduced by a fold factor. In another embodiment, immunogenicity is reduced by a 50-fold factor. In another embodiment, immunogenicity is reduced by a 100-fold factor. In another embodiment, immunogenicity is reduced by a 200-fold factor. In another embodiment, immunogenicity is reduced by a 500-fold factor. In another embodiment, immunogenicity is reduced by a 1000-fold factor. In another embodiment, immunogenicity is reduced by a 2000-fold factor. In another embodiment, immunogenicity is reduced by another fold difference.

Methods of determining immunogenicity are well known in the art, and include, e.g. measuring secretion of cytokines (e.g. IL-12, IFNalpha, TNF-alpha, RANTES, MIP-1alpha or beta, IL-6, IFN-beta, or IL-8), measuring expression of DC activation markers (e.g. CD83, HLA-DR, CD80 and CD86), or measuring ability to act as an adjuvant for an adaptive immune response.

In one embodiment, the chimeric antigen receptor (CAR) of the present disclosure may be a conditionally active CAR. A wild type protein or domain thereof, such as those described herein may be used to generate a conditionally active biologic protein which are reversibly or irreversibly inactivated at the wild type normal physiological conditions as well as to such conditionally active biologic proteins and domains and uses of such conditional active biologic proteins and domains are provided. Such methods and conditionally active proteins are taught in, for example, International Publication No. WO2016033331, the contents of which are incorporated herein by reference in their entirety. As a non-limiting example, the CAR comprises at least one antigen specific targeting region evolved from a wild type protein or a domain thereof and one or more of a decrease in activity in the assay at the normal physiological condition compared to the antigen specific targeting region of the wild-type protein or a domain thereof, and an increase in activity in the assay under the aberrant condition compared to the antigen specific targeting region of the wild-type protein or a domain thereof.

Diseases and Toxins

Various infectious diseases may be treated with pharmaceutical compositions, biocircuits, biocircuit components, effector modules including their SREs or payloads of the present disclosure. As used herein, the term "infectious disease" refers to any disorders caused by organisms such as bacteria, viruses, fungi or parasites.

Various autoimmune diseases and autoimmune-related diseases may be treated with pharmaceutical compositions, biocircuits, biocircuit components, effector modules including their SREs or payloads of the present disclosure. As used herein, the term "autoimmune disease" refers to a disease in which the body produces antibodies that attack its own tissues.

Stem Cell Applications

The biocircuits of the present disclosure and/or any of their components may be utilized in the regulated reprogramming of cells, stem cell engraftment or other application where controlled or tunable expression of such reprogramming factors are useful.

The biocircuits of the present disclosure may be used in reprogramming cells including stem cells or induced stem cells. Induction of induced pluripotent stem cells (iPSC) was first achieved by Takahashi and Yamanaka (Cell, 2006. 126(4):663-76; herein incorporated by reference in its entirety) using viral vectors to express KLF4, c-MYC, OCT4 and SOX2 otherwise collectively known as KMOS.

The effector modules of the present disclosure may include a payload comprising any of factors that contribute stem cell mobilization. In autologous stem cell therapy, sources of stem cells for transplantation may include the bone marrow, peripheral blood mononuclear cells and cord blood. Stem cells are stimulated out of these sources (e.g., the bone marrow) into the blood stream. So sufficient stem cells are available for collection for future reinfusion. One or a combination of cytokines strategies may be used to mobilize the stem cells including but not limited to G-CSF (filgrastim), GM-CSF, and chemotherapy preceding with cytokines (chemomobilization).

Patient Stratification

In one embodiment, patients may also be stratified according to the immunogenic peptides presented by their immune cells and may be utilized as a parameter to determine suitable patient cohorts that may therapeutically benefit for the compositions of the disclosure.

Tools and Agents for Making Therapeutics

Provided in the present disclosure are tools and agents that may be used in generating therapeutics such as, but not limited to, immunotherapeutics for reducing a tumor volume or burden in a subject in need. A considerable number of variables are involved in producing a therapeutic agent, such as structure of the payload, type of cells, method of gene transfers, method and time of ex vivo expansion, preconditioning and the amount and type of tumor burden in the subject. Such parameters may be optimized using tools and agents described herein.

Cell Lines

The present disclosure provides a mammalian cell that has been genetically modified with the compositions of the disclosure. Suitable mammalian cells include primary cells and immortalized cell lines. Suitable mammalian cell lines include, but are not limited to Human embryonic kidney cell line 293, fibroblast cell line NIH 3T3, human colorectal carcinoma cell line HCT116, ovarian carcinoma cell line SKOV-3, immortalized T cell lines (e.g. Jurkat cells and SupT1 cells), lymphoma cell line Raji cells, NALM-6 cells, K562 cells, HeLa cells, PC12 cells, HL-60 cells, NK cell lines (e.g. NKL, NK92, NK962, and YTS), and the like. In some instances, the cell is not an immortalized cell line, but instead a cell obtained from an individual and is herein referred to as a primary cell. For example, the cell is a T lymphocyte obtained from an individual. Other examples include, but are not limited to cytotoxic cells, stem cells, peripheral blood mononuclear cells or progenitor cells obtained from an individual.

Tracking SREs, Biocircuits and Cell Lines

In some embodiments, it may be desirable to track the compositions of the disclosure or the cells modified by the compositions of the disclosure. Tracking may be achieved by using payloads such as reporter moieties, which, as used herein, refers to any protein capable of creating a detectable signal, in response to an input. Examples include alkaline phosphatase, β-galactosidase, chloramphenicol acetyltransferase, β-glucuronidase, peroxidase, β-lactamase, catalytic antibodies, bioluminescent proteins e.g. luciferase, and fluorescent proteins such as Green fluorescent protein (GFP).

Reporter moieties may be used to monitor the response of the SREs upon addition of the ligand corresponding to the SRE. In other instances, reporter moieties may be used to track cell survival, persistence, cell growth, and/or localization in vitro, in vivo, or ex vivo.

In some embodiments, the preferred reporter moiety may be luciferase proteins.

Diagnostics

In some embodiments, scFvs, CARs and compositions of the disclosure may be used as diagnostics. In some cases, scFvs, CARs and/compositions of the disclosure may be used to identify, label or stain cells, tissues, organs, etc. expressing target antigens. In further embodiments, scFvs, CARs and/compositions of the disclosure may be used to identify CD19 antigen present in tissue sections (i.e., histological tissue sections), including tissue known or suspected of having cancerous cells. Such methods of using scFvs of the disclosure may in some cases be used to identify cancerous cells or tumors in tissue sections. Tissue sections may be from any tissue or organ including, but not limited to breast, colon, pancreatic, ovarian, brain, liver, kidney, spleen, lung, skin, stomach, intestine, esophagus, and bone. scFvs, CARs and/compositions of the present disclosure may also be used to identify blood samples suspected to have or known to be cancerous blood sample and distinguish it from the normal tissue.

Diagnostics described herein can be used to determine whether a subject should be treated with a wild type CD19 CAR therapy or a CAR that recognizes mutant CD19. In a particular embodiment, the method comprises determining whether the cancer cell expresses a wild-type CD19 and/or a CD19 isoform, wherein the presence of a CD19 isoform and/or absence of wild type CD19 indicates that the cancer will be refractory to a wild type CD19 CAR therapy. Methods of determining whether a cancer cell expresses wild-type CD19 or a CD19 isoform or variant are described herein and include, without limitation, sequencing (e.g., all or part (e.g., ectodomain) of CD 19), isoform specific PCR, isoform-specific oligonucleotide or probe screening methods, recognition by isoform specific antibodies, etc.

T Cell Exhaustion

In some embodiments, biocircuits, their components, SREs or effector modules may be utilized to prevent T cell exhaustion. As used herein, "T cell exhaustion" refers to the stepwise and progressive loss of T cell function caused by chronic T cell activation. T cell exhaustion is a major factor limiting the efficacy of antiviral and antitumor immunotherapies. Exhausted T cells have low proliferative and cytokine producing capabilities concurrent with high rates of apoptosis and high surface expression of multiple inhibitory receptors. T cell activation leading to exhaustion may occur either in the presence or absence of the antigen.

In some embodiments, the biocircuits, and their components may be utilized to prevent T cell exhaustion in the context of Chimeric Antigen Receptor-T cell therapy (CAR-T). In this context, exhaustion in some instances, may be caused by the oligomerization of the scFvs of the CAR on the cell surface which leads to continuous activation of the intracellular domains of the CAR. As a non-limiting example, CARs of the present disclosure may include scFvs that are unable to oligomerize. As another non-limiting example, CARs that are rapidly internalized and re-expressed following antigen exposure may also be selected to prevent chronic scFv oligomerization on cell surface. In one embodiment, the framework region of the scFvs may be modified to prevent constitutive CAR signaling (Long et al. 2014. Cancer Research. 74(19) S1; the contents of which are incorporated by reference in their entirety). Tunable biocircuit systems of the present disclosure may be also used to regulate the surface expression of the CAR on the T cell surface to prevent chronic T cell activation. The CARs of the disclosure may also be engineered to minimize exhaustion. As a non-limiting example, the 41-BB signaling domain may be incorporated into CAR design to ameliorate T cell exhaustion. In some embodiments, any of the strategies disclosed by Long H A et al. may be utilized to prevent exhaustion (Long A H et al. (2015) Nature Medicine 21, 581-590; the contents of which are incorporated herein by reference in their entirety). In some embodiments, T cell metabolic pathways may be modified to diminish the susceptibility of T cells to exhaustion. Metabolic pathways may include, but are not limited to glycolysis, urea cycle, citric acid cycle, beta oxidation, fatty acid biosynthesis, pentose phosphate pathway, nucleotide biosynthesis, and glycogen metabolic pathways. As a non-limiting example, payloads that reduce the rate of glycolysis may be utilized to restrict or prevent T cell exhaustion (Long et al. Journal for Immunotherapy of Cancer 2013, 1(Suppl 1): P21; the contents of which are incorporated by reference in their entirety). In one embodiment, T cells of the present disclosure may be used in combination with inhibitors of glycolysis such as 2-deoxyglucose, and rapamycin.

In some embodiments, effector modules of the present disclosure, useful for immunotherapy may be placed under the transcriptional control of the T cell receptor alpha locus constant (TRAC) locus in the T cells. Eyquem et al. have shown that expression of the CAR from the TRAC locus prevents T cell exhaustion and the accelerated differentiation of T cells caused by excessive T cell activation (Eyquem J. et al (2017) Nature. 543(7643):113-117; the contents of which are incorporated herein by reference in their entirety).

Cells

In accordance with the present disclosure, cells genetically modified to express at least one biocircuit, SRE (e. g, DD), effector module and immunotherapeutic agent of the disclosure, are provided. Cells of the disclosure may include, without limitation, immune cells, stem cells and tumor cells. In some embodiments, immune cells are immune effector cells, including, but not limiting to, T cells such as CD8+ T cells and CD4+ T cells (e.g., Th1, Th2, Th17, Foxp3+ cells), memory T cells such as T memory stem cells, central T memory cells, and effector memory T cells, terminally differentiated effector T cells, natural killer (NK) cells, NK T cells, tumor infiltrating lymphocytes (TILs), cytotoxic T lymphocytes (CTLs), regulatory T cells (Tregs), and dendritic cells (DCs), other immune cells that can elicit an effector function, or the mixture thereof. T cells may be Tαβ cells and Tγδ cells. In some embodiments, stem cells may be from human embryonic stem cells, mesenchymal stem cells, and neural stem cells. In some embodiments, T cells may be depleted endogenous T cell receptors (See U.S. Pat. Nos. 9,273,283; 9,181,527; and 9,028,812; the contents of each of which are incorporated herein by reference in their entirety).

In some embodiments, cells of the disclosure may be autologous, allogeneic, syngeneic, or xenogeneic in relation to a particular individual subject.

In some embodiments, cells of the disclosure may be mammalian cells, particularly human cells. Cells of the disclosure may be primary cells or immortalized cell lines.

In some embodiments, cells of the disclosure may include expansion factors as payload to trigger proliferation and expansion of the cells. Exemplary payloads include RAS such as KRAS, NRAS, RRAS, RRAS2, MRAS, ERAS, and HRAS, DIRAS such as DIRAS1, DIRAS2, and DIRAS3, NKIRAS such as NKIRAS1, and NKIRAS2, RAL such as RALA, and RALB, RAP such as RAP1A, RAP1B, RAP2A, RAP2B, and RAP2C, RASD such as RASD1, and RASD2, RASL such as RASL10A, RASL10B, RASL11A, RASL11B, and RASL12, REM such as REM1, and REM2, GEM, RERG, RERGL, and RRAD.

Engineered immune cells can be accomplished by transducing a cell compositions with a polypeptide of a biocircuit, an effector module, a SRE and/or a payload of interest (i.e., immunotherapeutic agent), or a polynucleotide encoding said polypeptide, or a vector comprising said polynucleotide. The vector may be a viral vector such as a lentiviral vector, a gamma-retroviral vector, a recombinant AAV, an adenoviral vector and an oncolytic viral vector. In other aspects, non-viral vectors for example, nanoparticles and liposomes may also be used. In some embodiments, immune cells of the disclosure are genetically modified to express at least one immunotherapeutic agent of the disclosure which is tunable using a stimulus. In some examples, two, three or more immunotherapeutic agents constructed in the same biocircuit and effector module are introduced into a cell. In other examples, two, three, or more biocircuits, effector modules, each of which comprises an immunotherapeutic agent, may be introduced into a cell.

In some embodiments, immune cells of the disclosure may be T cells modified to express an antigen-specific T cell receptor (TCR), or an antigen specific chimeric antigen receptor (CAR) taught herein (known as CAR T cells). Accordingly, at least one polynucleotide encoding a CAR system (or a TCR) described herein, or a vector comprising the polynucleotide is introduced into a T cell. The T cell expressing the CAR or TCR binds to a specific antigen via the extracellular targeting moiety of the CAR or TCR, thereby a signal via the intracellular signaling domain (s) is transmitted into the T cell, and as a result, the T cell is activated. The activated CAR T cell changes its behavior including release of a cytotoxic cytokine (e.g., a tumor necrosis factor, and lymphotoxin, etc.), improvement of a cell proliferation rate, change in a cell surface molecule, or the like. Such changes cause destruction of a target cell expressing the antigen recognized by the CAR or TCR. In addition, release of a cytokine or change in a cell surface molecule stimulates other immune cells, for example, a B cell, a dendritic cell, a NK cell, and a macrophage.

The CAR introduced into a T cell may be a first-generation CAR including only the intracellular signaling domain from TCR CD3zeta, or a second-generation CAR including the intracellular signaling domain from TCR CD3zeta and a costimulatory signaling domain, or a third-generation CAR including the intracellular signaling domain from TCR CD3zeta and two or more costimulatory signaling domains, or a split CAR system, or an on/off switch CAR system.

In some embodiments, CAR T cells of the disclosure may be further modified to express another one, two, three or more immunotherapeutic agents. The immunotherapeutic agents may be another CAR or TCR specific to a different target molecule; a cytokine such as IL2, IL12, IL15 and IL18, or a cytokine receptor such as IL15Ra; a chimeric switch receptor that converts an inhibitory signal to a stimulatory signal; a homing receptor that guides adoptively transferred cells to a target site such as the tumor tissue; an agent that optimizes the metabolism of the immune cell; or a safety switch gene (e.g., a suicide gene) that kills activated T cells when a severe event is observed after adoptive cell transfer or when the transferred immune cells are no-longer needed. These molecules may be included in the same effector module or in separate effector modules.

In one embodiment, the CAR T cell (including TCR T cell) of the disclosure may be an "armed" CAR T cell which is transformed with an effector module comprising a CAR and an effector module comprising a cytokine. The inducible or constitutively secrete active cytokines further armor CAR T cells to improve efficacy and persistence. In this context, such CAR T cell is also referred to as "armored CAR T cell". The "armor" molecule may be selected based on the tumor microenvironment and other elements of the innate and adaptive immune systems.

Chimeric Antigen Receptor engineered T cells (CAR-T) therapies have yet to be successfully applied to solid tumors. Enhancing CAR-T cell functionality and selectively delivering cargo to the site of solid tumors represent key tactics to achieve effective CAR-T therapy for solid tumors. In one embodiment, Interleukin 12 (IL12) may be utilized to enhance the effectiveness of CAR-T cells, especially since it has the potential to remodel the tumor microenvironment. IL12 has been previously shown to be effective in enhancing efficacy of CAR or TCR modified T-cells as well as tumor infiltrating lymphocytes (TILs) in preclinical and clinical models. However, constitutive production of IL12 can compromise safety and/or efficacy; therefore, on demand, local delivery of the cytokine may be a preferred approach. In some embodiments, biocircuits of the present disclosure may be utilized to exogenously control IL12 expression to enable the use of IL12 in adoptive cell therapy.

In some embodiments, DD regulated Flexi IL12 constructs may be used to improve the efficacy of the CARs, especially in solid tumor settings, by providing a controlled local signal for tumor microenvironment remodeling and epitope spreading. DD regulation also provides rapid, dose dependent, and local production of Flexi IL12.

In some aspects, the armed CAR T cell of the disclosure is modified to express a CD19 CAR and IL12. Such T cells, after CAR mediated activation in the tumor, release inducible IL12 which augments T-cell activation and attracts and activates innate immune cells to eliminate CD19-negative cancer cells.

In one embodiment, T cells of the disclosure may be modified to express an effector module comprising a CAR and an effector module comprising a suicide gene.

In one embodiment, the CAR T cell (including TCR T cell) of the disclosure may be transformed with effector modules comprising a cytokine and a safety switch gene (e.g., suicide gene). The suicide gene may be an inducible caspase such as caspase 9 which induces apoptosis, when activated by an extracellular stimulus of a biocircuit system. Such induced apoptosis eliminates transferred cell as required to decrease the risk of direct toxicity and uncontrolled cell proliferation.

In some embodiments, immune cells of the disclosure may be NK cells modified to express an antigen-specific T cell receptor (TCR), or an antigen specific chimeric antigen receptor (CAR) taught herein.

Natural killer (NK) cells are members of the innate lymphoid cell family and characterized in humans by expression of the phenotypic marker CD56 (neural cell adhesion molecule) in the absence of CD3 (T-cell co-receptor). NK cells are potent effector cells of the innate immune system which mediate cytotoxic attack without the requirement of prior antigen priming, forming the first line of defense against diseases including cancer malignancies and viral infection.

Several pre-clinical and clinical trials have demonstrated that adoptive transfer of NK cells is a promising treatment approach against cancers such as acute myeloid leukemia (Ruggeri et al., Science; 2002, 295: 2097-2100; and Geller et al., Immunotherapy, 2011, 3: 1445-1459). Adoptive transfer of NK cells expressing CAR such as DAP12-Based Activating CAR revealed improved eradication of tumor cells (Topfer et al., J Immunol. 2015; 194:3201-3212). NK cell engineered to express a CS-1 specific CAR also displayed enhanced cytolysis and interferon-γ (IFN-γ) production in multiple myeloma (Chu et al., Leukemia, 2014, 28(4): 917-927).

NK cell activation is characterized by an array of receptors with activating and inhibitory functions. The important activation receptors on NK cells include CD94/NKG2C and NKG2D (the C-type lectin-like receptors), and the natural cytotoxicity receptors (NCR) NKp30, NKp44 and NKp46, which recognize ligands on tumor cells or virally infected cells. NK cell inhibition is essentially mediated by interactions of the polymorphic inhibitory killer cell immunoglobulin-like receptors (KIRs) with their cognate human-leukocyte-antigen (HLA) ligands via the alpha-1 helix of the HLA molecule. The balance between signals that are generated from activating receptors and inhibitory receptors mainly determines the immediate cytotoxic activation.

NK cells may be isolated from peripheral blood mononuclear cells (PBMCs), or derived from human embryonic stem (ES) cells and induced pluripotent stem cells (iPSCs). The primary NK cells isolated from PBMCs may be further expanded for adoptive immunotherapy. Strategies and protocols useful for the expansion of NK cells may include interleukin 2 (IL2) stimulation and the use of autologous feeder cells, or the use of genetically modified allogeneic feeder cells. In some aspects, NK cells can be selectively expanded with a combination of stimulating ligands including IL15, IL21, IL2, 41BBL, IL12, IL18, MICA, 2B4, LFA-1, and BCM1/SLAMF2 (e.g., US patent publication NO. US20150190471).

Immune cells expressing effector modules comprising a CAR and/or other immunotherapeutic agents can be used as cancer immunotherapy. The immunotherapy comprises the cells expressing a CAR and/or other immunotherapeutic agents as an active ingredient, and may further comprise a suitable excipient. Examples of the excipient may include the aforementioned pharmaceutically acceptable excipients, including various cell culture media, and isotonic sodium chloride.

In some embodiments, cells of the present disclosure may be dendritic cells that are genetically modified to express the compositions of the disclosure. Such cells may be used as cancer vaccines.

VI. Definitions

At various places in the present specification, features or functions of the compositions of the present disclosure are disclosed in groups or in ranges. It is specifically intended that the present disclosure include each and every individual sub combination of the members of such groups and ranges. The following is a non-limiting list of term definitions.

Activity: As used herein, the term "activity" refers to the condition in which things are happening or being done. Compositions of the disclosure may have activity and this activity may involve one or more biological events. In some embodiments, biological events may include cell signaling events. In some embodiments, biological events may include cell signaling events associated protein interactions with one or more corresponding proteins, receptors, small molecules or any of the biocircuit components described herein.

Adoptive cell therapy (ACT): The terms "Adoptive cell therapy" or "Adoptive cell transfer", as used herein, refer to a cell therapy involving in the transfer of cells into a patient, wherein cells may have originated from the patient, or from another individual, and are engineered (altered) before being transferred back into the patient. The therapeutic cells may be derived from the immune system, such as Immune effector cells: CD4+ T cell; CD8+ T cell, Natural Killer cell (NK cell); and B cells and tumor infiltrating lymphocytes (TILs) derived from the resected tumors. Most commonly transferred cells are autologous anti-tumor T cells after ex vivo expansion or manipulation. For example, autologous peripheral blood lymphocytes can be genetically engineered to recognize specific tumor antigens by expressing T-cell receptors (TCR) or chimeric antigen receptor (CAR).

Agent: As used herein, the term "agent" refers to a biological, pharmaceutical, or chemical compound. Non-limiting examples include simple or complex organic or inorganic molecule, a peptide, a protein, an oligonucleotide, an antibody, an antibody derivative, antibody fragment, a receptor, and soluble factor.

Agonist: the term "agonist" as used herein, refers to a compound that, in combination with a receptor, can produce a cellular response. An agonist may be a ligand that directly binds to the receptor. Alternatively, an agonist may combine with a receptor indirectly by, for example, (a) forming a complex with another molecule that directly binds to the receptor, or (b) otherwise resulting in the modification of another compound so that the other compound directly binds to the receptor. An agonist may be referred to as an agonist of a particular receptor or family of receptors, e.g., agonist of a co-stimulatory receptor.

Antagonist: the term "antagonist" as used herein refers to any agent that inhibits or reduces the biological activity of the target(s) it binds.

Antigen: the term "antigen" as used herein is defined as a molecule that provokes an immune response when it is introduced into a subject or produced by a subject such as tumor antigens which arise by the cancer development itself. This immune response may involve either antibody production, or the activation of specific immunologically-competent cells such as cytotoxic T lymphocytes and T helper cells, or both. An antigen can be derived from organisms, subunits of proteins/antigens, killed or inactivated whole cells or lysates. In the context of the disclosure, the terms "antigens of interest" or "desired antigens" refers to those proteins and/or other biomolecules provided herein that are immunospecifically bound or interact with antibodies of the present disclosure and/or fragments, mutants, variants, and/or alterations thereof described herein. In some embodiments, antigens of interest may comprise any of the polypeptides or payloads or proteins described herein, or fragments or portions thereof.

Approximately: As used herein, the term "approximately" or "about," as applied to one or more values of interest, refers to a value that is similar to a stated reference value. In certain embodiments, the term "approximately" or "about" refers to a range of values that fall within 25, 20, 19, 18, 17, 16, 15, 14, 13, 12, 11, 10, 9, 8, 7, 6, 5, 4, 3, 2, 1, or less in either direction (greater than or less than) of the stated reference value unless otherwise stated or otherwise evident from the context (except where such number would exceed 100 of a possible value).

Associated with: As used herein, the terms "associated with," "conjugated," "linked," "attached," and "tethered," when used with respect to two or more moieties, mean that the moieties are physically associated or connected with one another, either directly or via one or more additional moieties that serve as linking agents, to form a structure that is sufficiently stable so that the moieties remain physically associated under the conditions in which the structure is used, e.g., physiological conditions. An "association" need not be strictly through direct covalent chemical bonding. It may also suggest ionic or hydrogen bonding or a hybridization based connectivity sufficiently stable such that the "associated" entities remain physically associated.

Autologous: the term "autologous" as used herein is meant to refer to any material derived from the same individual to which it is later to be re-introduced into the individual.

Cancer: the term "cancer" as used herein refers a broad group of various diseases characterized by the uncontrolled growth of abnormal cells in the body. Unregulated cell division and growth results in the formation of malignant tumors that invade neighboring tissues ultimately metastasize to distant parts of the body through the lymphatic system or bloodstream.

Co-stimulatory molecule: As used herein, in accordance with its meaning in immune T cell activation, refers to a group of immune cell surface receptor/ligands which engage between T cells and APCs and generate a stimulatory signal in T cells which combines with the stimulatory signal in T cells that results from T cell receptor (TCR) recognition of antigen/MHC complex (pMHC) on APCs Cytokines: the term "cytokines", as used herein, refers to a family of small soluble factors with pleiotropic functions that are produced by many cell types that can influence and regulate the function of the immune system.

Delivery: the term "delivery" as used herein refers to the act or manner of delivering a compound, substance, entity, moiety, cargo or payload. A "delivery agent" refers to any agent which facilitates, at least in part, the in vivo delivery of one or more substances (including, but not limited to a compound and/or compositions of the present disclosure) to a cell, subject or other biological system cells.

Destabilized: As used herein, the term "destable," "destabilize," "destabilizing region" or "destabilizing domain" means a region or molecule that is less stable than a starting, reference, wild-type or native form of the same region or molecule.

Engineered: As used herein, embodiments of the disclosure are "engineered" when they are designed to have a feature or property, whether structural or chemical, that varies from a starting point, wild type or native molecule.

Expression: As used herein, "expression" of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; (4) folding of a polypeptide or protein; and (5) post-translational modification of a polypeptide or protein.

Feature: As used herein, a "feature" refers to a characteristic, a property, or a distinctive element.

Formulation: As used herein, a "formulation" includes at least a compound and/or composition of the present disclosure and a delivery agent.

Fragment: A "fragment," as used herein, refers to a portion. For example, fragments of proteins may comprise polypeptides obtained by digesting full-length protein. In some embodiments, a fragment of a protein includes at least 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 150, 200, 250 or more amino acids. In some embodiments, fragments of an antibody include portions of an antibody.

Functional: As used herein, a "functional" biological molecule is a biological entity with a structure and in a form in which it exhibits a property and/or activity by which it is characterized.

Immune cells: the term "an immune cell", as used herein, refers to any cell of the immune system that originates from a hematopoietic stem cell in the bone marrow, which gives rise to two major lineages, a myeloid progenitor cell (which give rise to myeloid cells such as monocytes, macrophages, dendritic cells, megakaryocytes and granulocytes) and a lymphoid progenitor cell (which give rise to lymphoid cells such as T cells, B cells and natural killer (NK) cells). Exemplary immune system cells include a CD4+ T cell, a CD8+ T cell, a CD4− CD8− double negative T cell, a T γδ cell, a Tαβ cell, a regulatory T cell, a natural killer cell, and a dendritic cell. Macrophages and dendritic cells may be referred to as "antigen presenting cells" or "APCs," which are specialized cells that can activate T cells when a major histocompatibility complex (MHC) receptor on the surface of the APC complexed with a peptide interacts with a TCR on the surface of a T cell.

Immunotherapy: the term "immunotherapy" as used herein, refers to a type of treatment of a disease by the induction or restoration of the reactivity of the immune system towards the disease.

Immunotherapeutic agent: the term "immunotherapeutic agent" as used herein, refers to the treatment of disease by the induction or restoration of the reactivity of the immune system towards the disease with a biological, pharmaceutical, or chemical compound.

In vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In vivo: As used herein, the term "in vivo" refers to events that occur within an organism (e.g., animal, plant, or microbe or cell or tissue thereof).

Linker: As used herein, a linker refers to a moiety that connects two or more domains, moieties or entities. In one embodiment, a linker may comprise 10 or more atoms. In a further embodiment, a linker may comprise a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. In some embodiments, a linker may comprise one or more nucleic acids comprising one or more nucleotides. In some embodiments, the linker may comprise an amino acid, peptide, polypeptide or protein. In some embodiments, a moiety bound by a linker may include, but is not limited to an atom, a chemical group, a nucleoside, a nucleotide, a nucleobase, a sugar, a nucleic acid, an amino acid, a peptide, a polypeptide, a protein, a protein complex, a payload (e.g., a therapeutic agent). or a marker (including, but not limited to a chemical, fluorescent, radioactive or bioluminescent marker). The linker can be used for any useful purpose, such as to form multimers or conjugates, as well as to administer a payload, as described herein. Examples of chemical groups that can be incorporated into the linker include, but are not limited to, alkyl, alkenyl, alkynyl, amido, amino, ether, thioether, ester, alkylene, heteroalkylene, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers, Other examples include, but are not limited to, cleavable moieties within the linker, such as, for example, a disulfide bond (—S—S—) or an azo bond (—N═N—), which can be cleaved using a reducing agent or photolysis. Non-limiting examples of a selectively cleavable bonds include an amido bond which may be cleaved for example by the use of tris(2-carboxyethyl) phosphine (TCEP), or other reducing agents, and/or photolysis, as well as an ester bond which may be cleaved for example by acidic or basic hydrolysis.

Checkpoint/factor: As used herein, a checkpoint factor is any moiety or molecule whose function acts at the junction of a process. For example, a checkpoint protein, ligand or receptor may function to stall or accelerate the cell cycle.

Metabolite: Metabolites are the intermediate products of metabolic reactions catalyzed by enzymes that naturally occur within cells. This term is usually used to describe small molecules, fragments of larger biomolecules or processed products.

Modified: As used herein, the term "modified" refers to a changed state or structure of a molecule or entity as compared with a parent or reference molecule or entity. Molecules may be modified in many ways including chemically, structurally, and functionally. In some embodiments, compounds and/or compositions of the present disclosure are modified by the introduction of non-natural amino acids.

Mutation: As used herein, the term "mutation" refers to a change and/or alteration. In some embodiments, mutations may be changes and/or alterations to proteins (including peptides and polypeptides) and/or nucleic acids (including polynucleic acids). In some embodiments, mutations comprise changes and/or alterations to a protein and/or nucleic acid sequence. Such changes and/or alterations may comprise the addition, substitution and or deletion of one or more amino acids (in the case of proteins and/or peptides) and/or nucleotides (in the case of nucleic acids and or polynucleic acids e.g., polynucleotides). In some embodiments, wherein mutations comprise the addition and/or substitution of amino acids and/or nucleotides, such additions and/or substitutions may comprise 1 or more amino acid and/or nucleotide residues and may include modified amino acids and/or nucleotides. The resulting construct, molecule or sequence of a mutation, change or alteration may be referred to herein as a mutant.

Neoantigen: the term "neoantigen", as used herein, refers to a tumor antigen that is present in tumor cells but not normal cells and do not induce deletion of their cognate antigen specific T cells in thymus (i.e., central tolerance). These tumor neoantigens may provide a "foreign" signal, similar to pathogens, to induce an effective immune response needed for cancer immunotherapy. A neoantigen may be restricted to a specific tumor. A neoantigen be a peptide/protein with a missense mutation (missense neoantigen), or a new peptide with long, completely novel stretches of amino acids from novel open reading frames (neoORFs). The neoORFs can be generated in some tumors by out-of-frame insertions or deletions (due to defects in DNA mismatch repair causing microsatellite instability), gene-fusion, read-through mutations in stop codons, or translation of improperly spliced RNA (e.g., Saeterdal et al., *Proc Natl Acad Sci USA,* 2001, 98: 13255-13260).

Off-target: As used herein, "off target" refers to any unintended effect on any one or more target, gene, cellular transcript, cell, and/or tissue.

Operably linked: As used herein, the phrase "operably linked" refers to a functional connection between two or more molecules, constructs, transcripts, entities, moieties or the like.

Payload or payload of interest (POI): the terms "payload" and "payload of interest (POI)", as used herein, are used interchangeable. A payload of interest (POI) refers to any protein or compound whose function is to be altered. In the context of the present disclosure, the POI is a component in the immune system, including both innate and adaptive immune systems. Payloads of interest may be a protein, a fusion construct encoding a fusion protein, or non-coding gene, or variant and fragment thereof. Payload of interest may, when amino acid based, may be referred to as a protein of interest.

Pharmaceutically acceptable excipients: the term "pharmaceutically acceptable excipient," as used herein, refers to any ingredient other than active agents (e.g., as described herein) present in pharmaceutical compositions and having the properties of being substantially nontoxic and non-inflammatory in subjects. In some embodiments, pharmaceutically acceptable excipients are vehicles capable of suspending and/or dissolving active agents. Excipients may include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, cross-linked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: Pharmaceutically acceptable salts of the compounds described herein are forms of the disclosed compounds wherein the acid or base moiety is in its salt form (e.g., as generated by reacting a free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. Pharmaceutically acceptable salts include the conventional non-toxic salts, for example, from non-toxic inorganic or organic acids. In some embodiments, a pharmaceutically acceptable salt is prepared from a parent compound which contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are preferred. Lists of suitable salts are found in Remington's Pharmaceutical Sciences, 17th ed., Mack Publishing Company, Easton, Pa., 1985, p. 1418, Pharmaceutical Salts: Properties, Selection, and Use, P. H. Stahl and C. G. Wermuth (eds.), Wiley-VCH, 2008, and Berge et al., Journal of Pharmaceutical Science, 66, 1-19 (1977), each of which is incorporated herein by reference in its entirety. Pharmaceutically acceptable solvate: The term "pharmaceutically acceptable solvate," as used herein, refers to a crystalline form of a compound wherein molecules of a suitable solvent are incorporated in the crystal lattice. For example, solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N, N'-dimethylformamide (DMF), N, N'-dimethyl acetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate." In some embodiments, the solvent incorporated into a solvate is of a type or at a level that is physiologically tolerable to an organism to which the solvate is administered (e.g., in a unit dosage form of a pharmaceutical composition).

Stable: As used herein "stable" refers to a compound or entity that is sufficiently robust to survive isolation to a useful degree of purity from a reaction mixture, and preferably capable of formulation into an efficacious therapeutic agent.

Stabilized: As used herein, the term "stabilize", "stabilized," "stabilized region" means to make or become stable. In some embodiments, stability is measured relative to an absolute value. In some embodiments, stability is measured relative to a secondary status or state or to a reference compound or entity.

Standard CAR: As used herein, the term "standard CAR" refers to the standard design of a chimeric antigen receptor. The components of a CAR fusion protein including the extracellular scFv fragment, transmembrane domain and one or more intracellular domains are linearly constructed as a single fusion protein.

Subject: As used herein, the term "subject" or "patient" refers to any organism to which a composition in accordance with the disclosure may be administered, e.g., for experimental, diagnostic, prophylactic, and/or therapeutic purposes. Typical subjects include animals (e.g., mammals such as mice, rats, rabbits, non-human primates, and humans) and/or plants.

Tandem: As used herein, the term "tandem" refers to a pattern of arrangement wherein two or more entities are arranged adjacent one another or act in conjunction. In some embodiments, the entity may be a nucleic acid or an amino acid. In one embodiment, the entity may be a payload. In one aspect, the payload may be an immunotherapeutic agent.

T cell: A T cell is an immune cell that produces T cell receptors (TCRs). T cells can be naïve (not exposed to antigen; increased expression of CD62L, CCR7, CD28, CD3, CD127, and CD45RA, and decreased expression of CD45RO as compared to $T_{CM}$), memory T cells ($T_M$) (antigen-experienced and long-lived), and effector cells (antigen-experienced, cytotoxic). TM can be further divided into subsets of central memory T cells ($T_{CM}$, increased expression of CD62L, CCR7, CD28, CD127, CD45RO, and CD95, and decreased expression of CD54RA as compared to naïve T cell and effector memory T cells ($T_{EM}$, decreased expression of CD62L, CCR7, CD28, CD45RA, and increased expression of CD127 as compared to naïve T cells or $T_{CM}$). Effector T cells ($T_E$) refers to antigen-experienced CD8+ cytotoxic T lymphocytes that have decreased expression of CD62L, CCR7, CD28, and are positive for granzyme and perforin as compared to $T_{CM}$. Other exemplary T cells include regulatory T cells, such as CD4+ CD25+ (Foxp3+) regulatory T cells and Treg17 cells, as well as Tr1, Th3, CD8+CD28−, and Qa-1 restricted T cells.

T cell receptor: T cell receptor (TCR) refers to an immunoglobulin superfamily member having a variable antigen binding domain, a constant domain, a transmembrane region, and a short cytoplasmic tail, which is capable of specifically binding to an antigen peptide bound to a MEW receptor. A TCR can be found on the surface of a cell or in soluble form and generally is comprised of a heterodimer having α and β chains (also known as TCRα and TCRβ, respectively), or γ and δ chains (also known as TCRγ and TCRδ, respectively). The extracellular portion of TCR chains (e.g., α-chain, β-chain) contains two immunoglobulin domains, a variable domain (e.g., α-chain variable domain or $V_\alpha$, β-chain variable domain or $V_\beta$) at the N terminus, and one constant domain (e.g., α-chain constant domain or $C_\alpha$ and β-chain constant domain or $C_\beta$,) adjacent to the cell membrane. Similar to immunoglobulin, the variable domains contain complementary determining regions (CDRs) separated by framework regions (FRs). A TCR is usually associated with the CD3 complex to form a TCR complex. As used herein, the term "TCR complex" refers to a complex formed by the association of CD3 with TCR. For example, a TCR complex can be composed of a CD3γ chain, a CD3δ chain, two CD3ε chains, a homodimer of CD3ζ chains, a TCRα chain, and a TCRβ chain. Alternatively, a TCR complex can be composed of a CD3γ chain, a CD3δ chain, two CD3ε chains, a homodimer of CD3ζ chains, a TCRγ chain, and a TCR chain. A "component of a TCR complex," as used herein, refers to a TCR chain (i.e., TCRα, TCRβ, TCRγ or TCRδ), a CD3 chain (i.e., CD3γ, CD3δ, CD3ε or CD3ζ), or a complex formed by two or more TCR chains or CD3 chains (e.g., a complex of TCRα and TCRβ, a complex of TCRγ and TCRδ, a complex of CD3ε and CD3δ, a complex of CD3γ and CD3ε, or a sub-TCR complex of TCRα, TCRβ, CD3γ, CD3δ, and two CD3ε chains.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition. In some embodiments, a therapeutically effective amount is provided in a single dose. In some embodiments, a therapeutically effective amount is administered in a dosage regimen comprising a plurality of doses. Those skilled in the art will appreciate that in some embodiments, a unit dosage form may be considered to comprise a therapeutically effective amount of a particular agent or entity if it comprises an amount that is effective when administered as part of such a dosage regimen.

Treatment or treating: As used herein, the terms "treatment" or "treating" denote an approach for obtaining a beneficial or desired result including and preferably a beneficial or desired clinical result. Such beneficial or desired clinical results include, but are not limited to, one or more of the following: reducing the proliferation of (or destroying) cancerous cells or other diseased, reducing metastasis of cancerous cells found in cancers, shrinking the size of the tumor, decreasing symptoms resulting from the disease, increasing the quality of life of those suffering from the disease, decreasing the dose of other medications required to treat the disease, delaying the progression of the disease, and/or prolonging survival of individuals.

Tune: As used herein, the term "tune" means to adjust, balance or adapt one thing in response to a stimulus or toward a particular outcome. In one non-limiting example, the SREs and/or DDs of the present disclosure adjust, balance or adapt the function or structure of compositions to which they are appended, attached or associated with in response to particular stimuli and/or environments.

EQUIVALENTS AND SCOPE

Those skilled in the art will recognize, or be able to ascertain using no more than routine experimentation, many equivalents to the specific embodiments in accordance with the disclosure described herein. The scope of the present disclosure is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The disclosure includes embodiments in which exactly one member of the group is present in, employed in, or otherwise relevant to a given product or process. The disclosure includes embodiments in which more than one, or the entire group members are present in, employed in or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the disclosure, to the tenth of the unit of the lower limit of the range, unless the context clearly dictates otherwise.

In addition, it is to be understood that any particular embodiment of the present disclosure that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the disclosure (e.g., any antibiotic, therapeutic or active ingredient; any method of production; any method of use; etc.) can be excluded from any one or more claims, for any reason, whether or not related to the existence of prior art.

It is to be understood that the words which have been used are words of description rather than limitation, and that changes may be made within the purview of the appended claims without departing from the true scope and spirit of the disclosure in its broader aspects.

While the present disclosure has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the disclosure. The present disclosure is further illustrated by the following nonlimiting examples.

EXAMPLES

Example 1: Regulation of Membrane Bound IL12

On day 0, primary human T cells were stimulated with Dynabeads (T-expander CD3/CD28) at a 3:1 bead: cell ratio in media containing 10% fetal bovine serum (FBS). The next day, lentiviruses produced with constructs OT-001407 (no IL12), OT-001563 (constitutive secreted IL12), or OT-001949 were added in the presence of reduced serum (5% FBS). On day 2, the cells were diluted 1:2 with fresh 10% FBS media. On day 6, the cells were counted for equal cell number plating, media replaced, and 10 µM Vardenafil was added or the cells were left untreated. On day 7, after overnight incubation, membrane IL12p70 expression was assessed by surface staining and flow cytometry. After an additional 4 h of treatment of cells with Brefeldin A (BD Biosciences), transduction efficiency was analyzed by flow cytometry for intracellular IL12p70 (BD Biosciences). The geometric mean fluorescence intensity of membrane bound IL12 expressed on human T cells transduced with OT-001949 increased by 2-fold after overnight vardenafil treatment as compared to untreated control. In contrast intracellular IL12p70 levels remained unchanged between the vardenafil and untreated control cells. The percentage of cells that were positive for membrane associated IL12 is shown Table 9.

TABLE 9

| Percentage IL12 positive cells | | | | |
|---|---|---|---|---|
| Description | OT-001407 | OT-001563 | OT-001949 (Vehicle Control) | OT-001949 (10 µM Vardenafil) |
| Surface IL12 | 1.43 | 8.68 | 20.8 | 52.3 |
| Intracellular IL12 | 0.24 | 82.4 | 63.0 | 65.8 |

After culturing T cells for 9 days as described above, 10 µM Vardenafil was added and cells were either left unstimulated or restimulated overnight with soluble ImmunoCult™ Human CD3/CD28 T Cell Activator (StemCell Technologies, Canada). The next day (day 10), transduction efficiency and membrane IL12 expression analysis was performed. The percentage of cells that are positive for surface expression of IL12 are shown in Table 10.

TABLE 10

| % surface IL12 positive cells | | | | |
|---|---|---|---|---|
| Description | Untransduced | OT-001563 | OT-001949 (Vehicle Control) | OT-001949 (10 µM Vardenafil) |
| Unstimulated | 1.25 | 2.09 | 2.82 | 13.2 |
| 15 h CD3/CD28 | 1.60 | 6.29 | 18.2 | 58.3 |

As shown in Table 10, OT-001949 transduced T cells showed an increase in surface expression of IL12 both in the unstimulated group as well as the CD3/CD28 stimulated group. However, vardenafil regulated expression of membrane associated IL12-PDE5 after 10 days of culture, and with restimulation was greater than the unstimulated group showing that restimulation with soluble CD3/CD28 is required for maximal expression.

On day 10 of culture, and after overnight incubation, T cell supernatants were collected for IL12p70 and Interferon-γ (IFNγ) MSD assays. Membrane associated expression of IL12 in OT-001949 reduced IL12 levels in the supernatant by 10,000 fold as compared to a secreted form of IL12 in OT-001563 transduced T cells. The reduction in the secreted IL12 levels in OT-001949 transduced cells was observed both in unstimulated as well as CD3/CD28 stimulated cells. Basal levels of membrane IL12 were sufficient to skew the T cells towards Th1 phenotype during in vitro expansion, resulting in IFNg secretion upon re-stimulation with soluble CD3/CD28.

IL12 levels in regulated, membrane associated IL12 were compared to constitutively expressed membrane associated IL12. On day 0, primary human T cells were stimulated with Dynabeads (T-expander CD3/CD28) at a 3:1 bead: cell ratio in media containing 10% fetal bovine serum (FBS). The next day, lentiviruses corresponding to constructs OT-001563 (constitutive secreted IL12), OT-001949 (regulated membrane associated IL12), or OT-001893 (constitutive membrane associated IL12) were added in the presence of reduced serum (5% FBS). On day 2, the cells were diluted 1:2 with fresh 10% FBS media. On day 6, the cells were counted for equal cell number plating, media replaced, and 10 µM vardenafil was added. On day 7, after overnight incubation membrane IL12p70 expression was assessed by surface staining and flow cytometry. After an additional 4h of treatment of cells with Brefeldin A (BD Biosciences), transduction efficiency was analyzed by flow cytometry for intracellular IL12p70 (BD Biosciences). The percentage of cells expressing surface IL12 is shown in Table 11.

TABLE 11

Surface IL12 positive expression with regulated and constitutive IL12

| Description | Transduction Efficiency (% intracellular IL12p70 staining) | Vehicle control | 5 μM Vardenafil |
|---|---|---|---|
| Untransduced | 0 | 1.45 | 1.19 |
| OT-001563 | 48.1 | 3.66 | 2.01 |
| OT-001949 | 64.3 | 27.7 | 56.8 |
| OT-001893 | 59.4 | 56.0 | 52.0 |

As shown in Table 11, the constitutively expressed membrane associated IL12 construct showed strong surface expression both in the presence and absence of ligand. As expected, only the regulated OT-001949 showed vardenafil dependent regulation of IL12. Little to no surface expression of IL12 was observed with the secreted IL12 construct OT-001563.

Example 2: Membrane Bound IL12 Dose Response Curve with Vardenafil and Tadalafil After culturing T cells as described in Example 2, for a total of 9 days, T cells transduced with construct OT-001949 were treated overnight with a dose response of vardenafil or tadalafil and restimulated with soluble ImmunoCult™ Human CD3/CD28 T Cell Activator (StemCell Technologies). The next day, surface IL12 expression was analyzed by flow cytometry. Results are provided in Table 12 and Table 13, where Unt indicates untreated, VDF indicates vardenafil and TDF indicates tadalafil.

TABLE 12

| | % p70 | | | | | | | | | | | |
|---|---|---|---|---|---|---|---|---|---|---|---|---|
| Ligand Concentration | OT-001563 | | OT-001949 | | OT-001893 | | OT-001563 | | OT-001949 | | OT-001893 | |
| (uM) | Unt. | VDF | Unt. | VDF | Unt. | VDF | Unt. | TDF | Unt. | TDF | Unt. | TDF |
| 10 | — | 36.7 | — | 70.5 | — | 94.1 | — | 26.2 | — | 67.1 | — | 93.8 |
| 3 | 8.06 | 39.4 | 37.9 | 70.4 | 73 | 94.7 | 3.81 | 25.7 | 24.7 | 63.9 | 74.4 | 94.2 |
| 1.1 | — | 43.1 | — | 69.5 | — | 95.3 | — | 30.1 | — | 61.7 | — | 93.9 |
| 0.4 | — | 45.4 | — | 67.5 | — | 95.3 | — | 33.6 | — | 55 | — | 94.4 |
| 0.1 | — | 51.1 | — | 67.6 | — | 95.5 | — | 33.5 | — | 47.9 | — | 94.3 |
| 0.04 | — | 53.7 | — | 63.2 | — | 95.4 | — | 27.1 | — | 42.3 | — | 94.7 |
| 0.01 | — | 59.6 | — | 57.9 | — | 95.1 | — | 24.8 | — | 39 | — | 94.3 |
| 0.005 | — | 62.9 | — | 57 | — | 95.3 | — | 23 | — | 38 | — | 94.8 |
| 0.002 | — | 51.5 | — | 51.7 | — | 95.1 | — | 23.1 | — | 38.1 | — | 94.5 |
| 0.0001 | 6.7 | 49.4 | 13.4 | 51.7 | 75 | 95.5 | 3.9 | 24.7 | 10.3 | 41.5 | 74.2 | 94.4 |

TABLE 13

| | Geometric Median Fluorescence Intensity | | | | | | | | | | | |
|---|---|---|---|---|---|---|---|---|---|---|---|---|
| Ligand Concentration | OT-001563 | | OT-001949 | | OT-001893 | | OT-001563 | | OT-001949 | | OT-001893 | |
| (uM) | Unt. | VDF | Unt. | VDF | Unt. | VDF | Unt. | VDF | Unt. | VDF | Unt. | VDF |
| 10 | — | 6400 | — | 21756 | — | 64014 | — | 4646 | — | 15746 | — | 83595 |
| 3 | 5809 | 6792 | 10074 | 20651 | 39118 | 71634 | 4505 | 4616 | 6767 | 10653 | 46181 | 82590 |
| 1.1 | — | 6810 | — | 17338 | — | 78149 | — | 4633 | — | 7929 | — | 83452 |
| 0.4 | — | 6869 | — | 12335 | — | 81210 | — | 4709 | — | 6439 | — | 83896 |
| 0.1 | — | 6969 | — | 9169 | — | 82860 | — | 4735 | — | 5933 | — | 85981 |
| 0.04 | — | 6941 | — | 7307 | — | 82986 | — | 4557 | — | 5620 | — | 83170 |
| 0.01 | — | 7295 | — | 6686 | — | 82750 | — | 4566 | — | 5501 | — | 80216 |
| 0.005 | — | 7375 | — | 6501 | — | 83606 | — | 4508 | — | 5446 | — | 82515 |
| 0.002 | — | 6665 | — | 6383 | — | 83827 | — | 4477 | — | 5478 | — | 83076 |
| 0.0001 | 5851 | 6455 | 5472 | 6289 | 46013 | 85139 | 4623 | 4516 | 5105 | 5662 | 45506 | 81992 |

EC50 values were calculated either using the frequency of T cells that were found to express surface IL12p70 (% IL12p70) or using the geometric mean fluorescence intensity of surface IL12p70 within the IL12p70 positive T cell gate (GeoMFI). In both cases, vardenafil appeared to have 10-fold higher potency for OT-001949 binding than tadalafil. Using the % IL12p70 method: the EC50 of vardenafil was 0.02 µM and the EC50 of tadalafil was 0.3 µM. Using the GeoMFI (geometric median fluorescence intensity) method: the EC50 of vardenafil was 0.6 µM and the EC50 of tadalafil was 904.

Example 3: Regulation of Membrane Associated IL12 in Tandem IL12 CAR Constructs

On day 0, primary human T cells were stimulated with Dynabeads (T-expander CD3/CD28) at a 3:1 bead: cell ratio in media containing 10% fetal bovine serum (FBS). The next day, lentivirus produced with construct OT-001895 (CD19-CAR-P2A-constitutive membrane associated IL12) was added in the presence of reduced serum (5% FBS). On day 2, the cells were diluted 1:2 with fresh 10% FBS media. On day 7, the cells were counted for equal cell number plating, media replaced. On day 8, after overnight incubation, transduction efficiency was analyzed by flow cytometry using CD19-Fc to detect surface CAR expression and an anti-IL12p70 antibody (BD Biosciences) to detect membrane associated IL12p70 surface expression. Both markers revealed that the T cells were ~25% transduced for both markers, and that CAR positive cells also expressed IL12 on the cell surface.

Regulation was tested using 5 µM vardenafil. T cells were transduced with constructs described herein using methods previously described. Cells were treated with ligand for 24 hours and analyzed by FACS. Table 14 shows the percentage of CAR positive cells and the median fluorescence intensity (MFI) of IL12 within the CAR positive subsets.

TABLE 14

CD19 CAR and surface IL12 expression

| Construct | % CAR positive cells | IL12 MFI in CAR positive subset | | |
|---|---|---|---|---|
| | | No Ligand | 5 µM vardenafil | Stabilization ratio |
| OT-001894 | 1.04 | 955 | 3331 | 3.49 |
| OT-001891 | 12.1 | 1038 | 12599 | 12.14 |
| OT-001895 | 33.5 | 91114 | — | — |
| OT-001357 | 65.3 | (−53.2) | — | — |
| OT-001407 | 52.1 | (−40.5) | — | — |
| Untransduced | 0.21 | — | — | — |

As shown in Table 14, both the regulatable constructs OT-001894 and OT-001891 showed ligand dependent stabilization and stabilization ratios greater than 1. These data show the regulation of IL12 in CAR positive T cells when transduced with tandem IL12 CAR constructs.

HEK293T cells were transiently transfected for 48 hours with DNA from constructs OT-001895 (constitutive membrane associated IL12), OT-001894 (regulated membrane associated), OT-001891 (regulated membrane associated). Vehicle control (DMSO) or 1 µM Vardenafil was added during the final 24 hours of culture. Surface CD19-CAR and membrane IL12 expression were assessed by flow cytometry and the results are shown in Table 15 and Table 16.

TABLE 15

CD19 CAR and surface IL12 expression

| | Vehicle control | | | 1 µM Vardenafil | | |
|---|---|---|---|---|---|---|
| Description | IL 12 positive | CAR positive | IL12 and CAR double positive | IL12 positive | CAR positive | IL 12 and CAR double positive |
| Untransfected | 5.98E−3 | 0.27 | 1.99E−3 | — | — | — |
| OT-001891 | 2.71 | 10.5 | 4.20 | 12.9 | 6.04 | 21.0 |

TABLE 16

CD19 CAR and surface IL12 expression

| | Vehicle control | | | 1 µM Vardenafil | | |
|---|---|---|---|---|---|---|
| Description | IL 12 positive | CAR positive | IL12 and CAR double positive | IL 12 positive | CAR positive | IL12 and CAR double positive |
| OT-001895 | 30.1 | 1.35 | 16.6 | — | — | — |
| OT-001894 | 0.75 | 15.0 | 4.05 | 15.0 | 2.85 | 17.7 |

As shown in Table 15 and Table 16, both the PDE5 DD regulated membrane associated constructs showed ligand dependent regulation as evidenced by the increase in the percentage of cells that are positive for both CD19 CAR and IL12. As expected, the untransfected population of cells did not show any significant expression of either IL12 and CAR and the constitutively expressed construct showed expression of both payloads even in the absence of ligand.

Example 4: Regulation of Membrane Bound IL12 from Tandem IL12 CAR Constructs in Primary Human T Cells On day 0, primary human T cells were stimulated with Dynabeads (T-expander CD3/CD28) at a 3:1 bead: cell ratio in media containing 10% fetal bovine serum (FBS). The next day, lentivirus produced with constitutive membrane bound IL12 (OT-001895) or PDE5-regulated membrane bound IL12 (OT-001891) constructs were added in the presence of reduced serum (5% FBS). On day 2, the cells were diluted 1:2 with fresh 10% FBS media. On day 6, the cells were counted for equal cell number plating, media replaced. Cells were treated overnight (20 hours) without or with ligands (5 uM Vardenafil) in the absence or presence of antigen re-stimulation with parental K562 cells versus K562 cells stably expressing the CAR antigen CD19 at a E:T ratio of 1:2. On day 7, after overnight incubation, transduction efficiency was analyzed by flow cytometry using CD19-Fc to detect surface CAR expression and IL12 p70 antibody to measure surface IL12 levels.

Table 17 shows the percentage of CAR positive cells and the median fluorescence intensity (MFI) of IL12 within the CAR positive subsets.

TABLE 17

CD19 CAR and surface IL12 expression

| Construct | % CAR positive cells | IL12 MFI in CAR positive subset | | Stabilization ratio |
|---|---|---|---|---|
| | | No Ligand | 5 μM vardenafil | |
| OT-001891 | 13.2 | 1613 | 26701 | 16.55 |
| OT-001895 | 34.3 | 140686 | — | — |

As shown in Table 17, the regulatable construct OT-001891 showed ligand dependent stabilization and stabilization ratios greater than 1. These data show the regulation of IL12 in CAR positive T cells when transduced with tandem IL12 CAR constructs. These data show that a membrane-tethered form of IL12 can also be regulated by destabilizing domain (DD) technology and might provide added control over systemic toxicity.

Example 5: Expression of Membrane Bound IL12 with B7.1 Transmembrane Domain

Membrane bound IL12 (mbIL12) expressed in tandem with a CD19-CAR and P2A were tested in primary human T cells. On day 0, primary human T cells were stimulated with Dynabeads (T-expander CD3/CD28) at a 3:1 bead: cell ratio in media containing 10% fetal bovine serum (FBS). The next day, lentivirus produced with a) OT-002011 with a B7.1 transmembrane (TM) domain and short CD8 hinge domain (b) OT-001895 with a CD8 TM and hinge domain (c) OT-002043 with a B7.1 TM and CD8 hinge domain constructs were added in the presence of reduced serum (5% FBS). On day 2, the cells were diluted 1:2 with fresh 10% FBS media. On day 6, cells were plated, media replaced, and transduction efficiency was analyzed on day 7 by flow cytometry using CD19-Fc to detect surface CAR expression. An IL12 p70 antibody (BD) was used to detect surface IL12 expression on CAR+ T cells. Table 18 shows the percentage of CAR positive cells and the median fluorescence intensity (MFI) of IL12 within the CAR positive subsets.

TABLE 18

CD19 CAR and surface IL12 expression

| Construct | % CAR positive cells | IL12 MFI in CAR positive subset |
|---|---|---|
| OT-002011 | 36.3 | 61945 |
| OT-001895 | 34.3 | 140686 |
| OT-002043 | 0.20 | 1878 |

As shown in Table 18 with OT-002011 and OT-001895 expressed IL12 on the surface, while OT-002043 was not surface expressed. The data demonstrate that either a CD8 TM with a CD8 hinge structure, or a B7.1 TM with a short CD8 hinge structure can be used to display IL12 on the surface of a T cell.

T cells were transduced with the following constructs using methods described in herein: (a) OT-001895 with a CD8 TM domain and aCD8 hinge domain (b) OT-002011 with a B7.1 TM domain and a short CD8 hinge domain (c) OT-002111 with a B7.1 TM domain and B7.1 CH2 domain as a hinge domain (d) OT-002096 with a B7.1 TM domain and IgG1 CH2-CH3 domain as a hinge domain (e) OT-002112 with a B7.1 TM domain and FcgammaR2b (Fcgr2b) as a hinge domain or (f) OT-001407 control. On day 2, the cells were diluted 1:2 with fresh 10% FBS media. On day 7, cells were counted, media replaced and plated at an E:T ratio of 1:2 with parental K562 cells versus K562 cells stably expressing the CAR antigen CD19. Transduction efficiency was analyzed on day 8 by flow cytometry using CD19-Fc to detect surface CAR expression. Table 19 shows the percentage of CAR positive cells.

TABLE 19

CD19 CAR, IL12 and IFN gamma expression

| Construct | % CAR positive cells | Geometric Mean of IL12p70 on CAR+ Cells | Secreted or Shed IL12p70 without antigen per 1e4 CAR+ cells in 20 hours (pg/mL) | Secreted IFNgamma per 1e4 CAR+ T cells in 20 hours in the presence of CD19-K562 cells (pg/mL) |
|---|---|---|---|---|
| OT-001895 | 40.3 | 117840 | 270 | 132924 |
| OT-002011 | 42.7 | 62859 | 66 | 102803 |
| OT-002111 | 27.1 | 54633 | 285 | 84830 |
| OT-002096 | 6.88 | 19828 | 4 | 30400 |
| OT-002112 | 28.2 | 47936 | 491 | 93285 |
| OT-001407 CAR control | 54.3 | 455 | 0 | 15695 |
| OT-001357 IL12/CAR control | 62.8 | 820 | 1924 | 114484 |

All constructs tested showed CAR expression (see Table 19). A high level of surface IL12p70 expression was observed on CAR+ T cells with all constructs tested except for the CAR only control cells OT-001407.

Cytokine that had accumulated in the overnight culture supernatants (from 10,000 CAR-T cells per 200 uL media) were measured using human IL12p70 and human interferon-gamma MSD V-plex assay kits (Meso Scale Discovery). CAR-Ts expressing secreted IL12 (OT-001357) were used as a control for cytokine expression in this experiment. All mbIL12 constructs shed much less IL12 into the cell supernatants than the secreted IL12 construct. OT-001895, OT-002111, OT-002112 expressed similar shed levels of IL12p70, while OT-002011 shed ~5-fold less IL12 than the highest shed-level constructs, and OT-002096 shed ~100-fold less IL12 than all other mbIL12 constructs. All constructs were active in their ability to induce Th1-shewing of T cells, as evidenced by greater levels of IFN-gamma production in the presence of antigen than CAR-Ts not expressing IL12.

Example 6: Bystander and Transactivation Effects of CD19 CAR-mbIL12 Constructs

Membrane bound IL12 (mbIL12) was expressed in tandem with a CD19-CAR and tested in primary human T cells.

On day 0, primary human T cells were stimulated with Dynabeads (T-expander CD3/CD28) at a 3:1 bead:cell ratio in media containing 10% fetal bovine serum (FBS). The next day, lentivirus with mbIL12 in tandem with a CD19-CAR construct was added in the presence of reduced serum (5% FBS). After 7 days of T cell expansion, increasing numbers of CAR+ T cells were cocultured with 10,000 GFP+, CAR-negative T cells. At the end of 1 hour of co-culture, the phospho-STAT4 levels within the GFP+ T cells were quantitated by flow cytometry using reagents and methods from BD. To determine the relative amount of IL12 activity that had accumulated in the T cell supernatants during the hour-long co-culture, cell supernatants from the co-culture were transferred to a new plate of GFP+ T cells and incubated for 1 hour. Phospho-STAT4 levels were measured in the GFP+ T cells incubated with the supernatants from the original co-culture. The transactivation (IL12 geometric mean fluorescence (MFI) on GFP+ cells in co-culture) and the bystander effect (pSTAT4 geometric MFI on GFP+ T cells in 1 hour supernatants) for a CAR-IL12+:GFP+ ratio of 64 are shown in Table 20.

TABLE 20

Transactivation and Bystander Effect at a CAR-IL12+:GFP+ ratio of 64

| | OT-001407 | OT-001356 | OT-001895 | OT-002011 | OT-002111 | OT-002096 | OT-002112 |
|---|---|---|---|---|---|---|---|
| Transactivation | 2287 | 6452 | 7699 | 8086 | 5461 | 5222 | 8016 |
| Bystander Effect | −1483 | | | | | | |

The transactivation (pSTAT4 geometric mean fluorescence (MFI) on GFP+ cells in co-culture) and the bystander effect (pSTAT4 geometric MFI on GFP+ T cells in 1 hour supernatants) for the constructs at different ratios are summarized below. For OT-001407, when (a) the CAR-IL12+:GFP+ ratio was 32, the transactivation was 1711 and the bystander effect was −1680, (b) the CAR-IL12+:GFP+ ratio was 16, the transactivation was 1768 and the bystander effect was −1632, (c) the CAR-IL12+:GFP+ ratio was 8, the transactivation was 1433 and the bystander effect was −1603, (d) the CAR-IL12+:GFP+ ratio was 4, the transactivation was 1195 and the bystander effect was −1860, and (e) the CAR-IL12+:GFP+ ratio was 2, the transactivation was 1101 and the bystander effect was −1800. For OT-001356, when (a) the CAR-IL12+:GFP+ ratio was 73.9, the transactivation was 6452 and the bystander effect was −2617, (b) the CAR-IL12+:GFP+ ratio was 37, the transactivation was 6935 and the bystander effect was −1404, (c) the CAR-IL12+:GFP+ ratio was 18.5, the transactivation was 6417 and the bystander effect was −226, (d) the CAR-IL12+:GFP+ ratio was 9.2, the transactivation was 5568 and the bystander effect was −86, (e) the CAR-IL12+:GFP+ ratio was 4.6, the transactivation was 4374 and the bystander effect was −518, and (f) the CAR-IL12+:GFP+ ratio was 2.3, the transactivation was 2839 and the bystander effect was −1093. For OT-001895, when (a) the CAR-IL12+:GFP+ ratio was 34.1, the transactivation was 7699 and the bystander effect was −3724, (b) the CAR-IL12+:GFP+ ratio was 17.1, the transactivation was 7718 and the bystander effect was −2996, (c) the CAR-IL12+:GFP+ ratio was 8.5, the transactivation was 8200 and the bystander effect was −1178, (d) the CAR-IL12+:GFP+ ratio was 4.3, the transactivation was 7172 and the bystander effect was −277, (e) the CAR-IL12+:GFP+ ratio was 2.1, the transactivation was 6095 and the bystander effect was −238, and (f) the CAR-IL12+:GFP+ ratio was 1.1, the transactivation was 4498 and the bystander effect was −136. For OT-002011, when (a) the CAR-IL12+:GFP+ ratio was 75.8, the transactivation was 8086 and the bystander effect was −3531, (b) the CAR-IL12+:GFP+ ratio was 37.9, the transactivation was 8031 and the bystander effect was −2884, (c) the CAR-IL12+:GFP+ ratio was 18.9, the transactivation was 8324 and the bystander effect was −1376, (d) the CAR-IL12+:GFP+ ratio was 9.5, the transactivation was 7765 and the bystander effect was −1133, (e) the CAR-IL12+:GFP+ ratio was 4.7, the transactivation was 6682 and the bystander effect was −566, and (f) the CAR-IL12+:GFP+ ratio was 2.4, the transactivation was 5190 and the bystander effect was −642. For OT-002111, when (a) the CAR-IL12+:GFP+ ratio was 47.1, the transactivation was 5461 and the bystander effect was −4244, (b) the CAR-IL12+:GFP+ ratio was 23.6, the transactivation was 7633 and the bystander effect was −1014, (c) the CAR-IL12+:GFP+ ratio was 11.8, the transactivation was 7663 and the bystander effect was −58, (d) the CAR-IL12+:GFP+ ratio was 5.9, the transactivation was 7211 and the bystander effect was 437, (e) the CAR-IL12+:GFP+ ratio was 2.9, the transactivation was 6545 and the bystander effect was 852, and (f) the CAR-IL12+:GFP+ ratio was 1.5, the transactivation was 4663 and the bystander effect was −59. For OT-002096, when (a) the CAR-IL12+:GFP+ ratio was 77.5, the transactivation was 5222 and the bystander effect was 955, (b) the CAR-IL12+:GFP+ ratio was 38.7, the transactivation was 4859 and the bystander effect was 1470, (c) the CAR-IL12+:GFP+ ratio was 19.4, the transactivation was 4179 and the bystander effect was 1473, (d) the CAR-IL12+:GFP+ ratio was 9.7, the transactivation was 4030 and the bystander effect was 1653, (e) the CAR-IL12+:GFP+ ratio was 4.8, the transactivation was 3247 and the bystander effect was 1052, and (f) the CAR-IL12+:GFP+ ratio was 2.4, the transactivation was 2615 and the bystander effect was 405. For OT-002096, when (a) the CAR-IL12+:GFP+ ratio was 40.4, the transactivation was 8016 and the bystander effect was −2659, (b) the CAR-IL12+:GFP+ ratio was 20.2, the transactivation was 8421 and the bystander effect was −1395, (c) the CAR-IL12+: GFP+ ratio was 10.1, the transactivation was 8117 and the bystander effect was −988, (d) the CAR-IL12+:GFP+ ratio was 5, the transactivation was 7756 and the bystander effect was −232, (e) the CAR-IL12+:GFP+ ratio was 2.5, the transactivation was 6070 and the bystander effect was −818, and (e) the CAR-IL12+:GFP+ ratio was 1.3, the transactivation was 5108 and the bystander effect was −1.

These data demonstrate that the level of IL12 shed from OT-001895, OT-002011, OT-002111, and OT-002112 constructs in one hour is sufficient to activate the IL12 receptor on bystander (GFP+) T cells to induce STAT4 phosphorylation. In contrast, the construct with the least shedding of mbIL12, OT-002096, can transactivate GFP+ T cells to phosphorylate STAT4 in a co-culture assay, but does not shed enough IL12 during the one hour assay to induce bystander effects.

Example 7: Effect of mbIL12 on CAR Activity

The following constructs were transduced into T cells: OT-001356, OT-001407, OT-001895, OT-002011, OT-002111, OT-002096, OT-02171. The cells were expanded for 10 days and utilized for cytotoxicity assays. Percentage of CAR positive cells obtained with each of the constructs was as follows: OT-001356: 45.3%; OT-001407, OT-001895: 29.4%, OT-002011: 24.3%, OT-002111: 19.6%, OT-002096: 6.08%.

For cytotoxicity assays, T cells were thawed and co-cultured with Nalm-6 cells (stably expressing NucRed®) at different T cells to Nalm-6 cell culture ratios. Target cell viability was determined by measuring cellular fluorescence over time using an Incucyte assay and the results are shown in Table 21.

TABLE 21

| | 48 hour Cytotoxicity Assay | |
|---|---|---|
| Construct | Average Total Nalm6-NucRed Area after 48 hour at E:T ratio of 3:1 | Average Total Nalm6-NucRed Area after 48 hour at E:T ratio of 10:1 |
| Nalm6-NucRed Only control | — | 200,043 |
| Empty Vector control | 137,399 | 207,080 |
| OT-001407 (control) | 18,266 | 32,191 |
| OT-001356 | 33,079 | 32,236 |
| OT-001357 | 50,745 | 39,476 |
| OT-001895 | 43,856 | 38,089 |
| OT-002011 | 59,465 | 44,301 |
| OT-002111 | 42,520 | 42,899 |
| OT-002096 | 109,904 | 68,898 |

The data in Table 21 demonstrate that mbIL12 expressing CAR-Ts are equally efficacious as either control CAR-Ts or CAR-Ts expressing secreted IL12. Additionally, the IFN-gamma analysis (measured by MSD) provided similar results to previous analysis of the constructs.

Example 8: Regulated CD19-CAR-P2A-mbIL12-PDE5 Constructs

On day 0, primary human T cells were stimulated with Dynabeads (T-expander CD3/CD28) at a 3:1 bead: cell ratio in media containing 10% fetal bovine serum (FBS). The next day, lentivirus produced with constructs OT-001407 (CAR only control), OT-001895, OT-001894, OT-001891, OT-002044 were added in the presence of reduced serum (5% FBS). On day 2, the cells were diluted 1:2 with fresh 10% FBS media. On day 6, the cells were counted for equal cell number plating, media replaced, and 5 µM Vardenafil (or vehicle as control) was added for 20 hours. After overnight incubation, transduction efficiency was analyzed by flow cytometry using CD19-Fc to detect surface CAR expression. Surface IL12 expression within the CAR+ cell gate was detected with an anti-IL12p70 antibody (BD, Franklin Lakes, N.J.) and is shown in Table 22.

TABLE 22

CAR and Membrane Bound IL12 expression

| | | IL12 Geometric Mean within CAR+ Gate | | |
|---|---|---|---|---|
| Construct | % CAR+ | DMSO | Ligand (VDF) | Fold Change |
| OT-001407 | 52.9 | 249 | — | — |
| OT-001895 | 34.3 | 140686 | — | — |
| OT-001894 | 18.0 | 1901 | 46444 | 24 |
| OT-001891 | 13.2 | 1613 | 26701 | 17 |
| OT-002044 | 2.34 | 5383 | 34190 | 6 |

As shown in Table 22, Vardenafil treatment induced 17-24-fold increases in expression of surface IL12 when compared to vehicle control. In all instances the IL12 expression levels were less than a constitutively expressed CAR-mbIL12 construct OT-001895. Mutant PDE5 domains conferred a greater ability to regulate mbIL12 with Vardenafil than the wild-type version of PDE5 (OT-002044).

T cells were further expanded for a total of 10 days and then frozen in liquid nitrogen. Next, T cells were thawed and counted. 1-2e5 cells were plated per well of a 96-well V-bottom plate, re-stimulated with soluble CD3/CD28 Immunocult reagent (Stem Cell Technologies) and treated with a dose response of either Vardenafil or Tadalafil ranging from 0-6 µM, or 0-20 uM, respectively. After incubation for 24 hours, payload expression was analyzed by flow cytometry using CD19-Fc to detect surface CAR expression. Surface IL12 expression was detected with an anti-IL12p70 antibody (BD). Shed IL12 levels detected in the cell supernatants were quantitated by MesoScale Assay for IL12p70.

The Geometric Mean of surface IL12p70 expression on CAR+ cells (Table 23 and Table 24) and shed IL12 levels (Table 25 and Table 26) are shown below.

TABLE 23

Surface mbIL12 Geometric Mean on CAR+ T Cells with Dose Response of Vardenafil

| Ligand Concentration of Vardenafil (μM) | OT-001895 | OT-001894 (EC50 0.2 uM; 13 fold change over vehicle only) | OT-001891 (EC50 0.8 uM; 11 fold change over vehicle only) | OT-002044 |
|---|---|---|---|---|
| 6 | 102104 | 59075 | 41005 | 43746 |
| 3 | 73224 | 52105 | 37710 | 43684 |
| 1 | 57606 | 49730 | 25982 | 36660 |
| 0.3 | 51700 | 41160 | 11615 | 39348 |
| 0.1 | 76765 | 26322 | 4849 | 11081 |
| 0.04 | 83401 | 15189 | 3712 | 34365 |
| 0.01 | 35669 | 8364 | 3584 | 21170 |
| 0.004 | 52201 | 5580 | 3620 | 18967 |
| 0.001 | 55293 | 4897 | 3551 | 15776 |
| 0.0001 | 99938 | 4608 | 3675 | 14765 |

TABLE 24

Surface mbIL12 Geometric Mean on CAR+ T Cells with Dose Response of Tadalafil

| Ligand Concentration of Tadalafil (μM) | OT-001895 | OT-001894 (EC50 1.8 uM; 10 fold change over vehicle only) | OT-001891 (EC50 4.3 uM; 9 fold change over vehicle only) | OT-002044 |
|---|---|---|---|---|
| 20 | 101811 | 47763 | 34773 | 38130 |
| 6.7 | 105514 | 42621 | 26111 | 36019 |
| 2.2 | 96605 | 29653 | 12353 | 32220 |
| 0.7 | 104653 | 18092 | 4862 | 26341 |
| 0.2 | 94502 | 9863 | 3690 | 21019 |
| 0.08 | 101636 | 6181 | 3767 | 18006 |
| 0.03 | 53305 | 4837 | 3733 | 16135 |
| 0.009 | 69545 | 4584 | 3753 | 16816 |
| 0.003 | 58941 | 4299 | 3749 | 17036 |
| 0.0001 | 51859 | 4572 | 3619 | 15848 |

TABLE 25

Shed mbIL12 (Detected in Cell Supernatants) with Dose Response of Vardenafil (pg/mL per 1e5 CAR-T cells in 20 hours)

| Ligand Concentration of Vardenafil (μM) | OT-001895 | OT-001894 (EC50 0.2 uM; 3 fold change over vehicle only) | OT-001891 (EC50 0.8 uM; 3 fold change over vehicle only) | OT-002044 |
|---|---|---|---|---|
| 6 | 2068.2 | 257 | 140.3 | 513.3 |
| 3 | 2148 | 240 | 131.6 | 490.1 |
| 1 | 2123.3 | 228.4 | 103.2 | 517.6 |
| 0.3 | 2050.1 | 193.9 | 73.4 | 462.5 |
| 0.1 | 2058.2 | 147.8 | 57.4 | 433.1 |
| 0.04 | 2099.7 | 116.7 | 46 | 415.8 |
| 0.01 | 2016.7 | 93.7 | 47.4 | 363.4 |
| 0.004 | 2003.8 | 84.3 | 48.7 | 339.6 |
| 0.001 | 2055.7 | 76.9 | 47.1 | 329 |
| 0.0001 | 2061.4 | 79.9 | 45.8 | 300.1 |

TABLE 26

Shed mbIL12 (Detected in Cell Supernatants) with Dose Response of Tadalafil (pg/mL per 1e5 CAR-T cells in 20 hours)

| Ligand Concentration of Tadalafil (μM) | OT-001895 | OT-001894 (EC50 11 uM; 3 fold change over vehicle only) | OT-001891 (EC50 7 uM; 3 fold change over vehicle only) | OT-002044 |
|---|---|---|---|---|
| 20 | 2070.3 | 197.9 | 109.1 | 397.6 |
| 6.7 | 2130.4 | 166.2 | 87.9 | 406.2 |
| 2.2 | 2068.1 | 136.4 | 67.5 | 401.2 |
| 0.7 | 2084.5 | 99.6 | 51.6 | 358.5 |
| 0.2 | 2037.1 | 94.9 | 49.2 | 337.3 |
| 0.08 | 2139.8 | 81 | 47.4 | 310.3 |
| 0.03 | 2002 | 73.9 | 44.7 | 292.3 |
| 0.009 | 2051.9 | 71.7 | 46.3 | 279 |
| 0.003 | 2095.5 | 70.3 | 44.9 | 316.1 |
| 0.0001 | 2002.7 | 63.4 | 44.1 | 315.1 |

Example 9. In Vivo Efficacy and Phenotype Assessment for Membrane Bound IL12 (mbIL12) Containing CD8 Transmembrane (TM) Domain and CD8 Hinge Region in CD19-CAR T Cells The study was designed to determine if membrane bound IL12 (mbIL12) expressed on CAR-T cells via a CD8 TM domain and CD8 Hinge Region promotes CAR T cell expansion in cis, promotes non-CAR-T cell expansion in trans, and/or increases in vivo CAR T cell efficacy against CD19+ Nalm6 tumors. To test in vivo anti-tumor activity, experiments were performed in NSG mice. Nalm6 cells were transfected with Redifect Red-Fluc (Perkin Elmer) under selection using Puromycin for ~2 months to generate a line that stably expresses the luciferase reporter; thereafter named Nalm6-Luc. Ten days before tumor implantation, Nalm6-Luc cells were thawed and cultured in puromycin-containing media. On day 0, cells were counted, resuspended in PBS and injected into NSG mice via tail vein. On day 6, mice were imaged for bioluminescent intensity (BLI) and sorted into groups based on their tumor size ensuring that all groups had the same sized tumors. Human T cells were transduced with one of the following constructs as shown in the study design in Table 27:

TABLE 27

In Vivo Study Design

| Group | Mice (n) | CAR-T Cells (x10^6) | GFP+ Cells (x10^6) | Vector Name | Construct Description |
|---|---|---|---|---|---|
| 1 | 8 | 0 | 5 | Empty Vector | Empty Vector |
| 2 | 8 | 0.3 | 5 | OT-001407 | CD19-CAR alone |
| 3 | 8 | 1 | 5 | | |
| 4 | 8 | 0.3 | 5 | OT-001356 | CD19car-IRES-IL12 |
| 5 | 8 | 1 | 5 | | |
| 6 | 8 | 0.3 | 5 | OT-001357 | CD19car-P2A-IL12 |
| 7 | 8 | 1 | 5 | | |
| 8 | 8 | 0.3 | 5 | OT-001895 | CD19car-P2A-CD8Hinge/TM-IL12 |
| 9 | 8 | 1 | 5 | | |
| 10 | 8 | 0.3 | 5 | OT-00189 | CD19car-P2A-mbIL12-PDE5 (H653A, R732L |
| 11 | 8 | 1 | 5 | | |

Next, holding total CAR+ T cell dose constant at either 300,000 or 1 million cells per animal, transduced T cells were intravenously infused into mice on day 7. Tumors were monitored in mice using BLI and the mean of the Total Flux (photons/second) was calculated for each group as an indicator of tumor burden (Table 28). In order to track the trans effect of IL12 expressing CART cells on T cells that lack expression of IL12, 5 million GFP+ T cells (negative for IL12) were co-infused with the IL12-expressing CAR+ T cells, and peripheral blood draws taken over time to evaluate the effect of IL12 on phenotypic changes in GFP+ T cells by flow cytometry analysis.

TABLE 28

Mean Total Flux (Nalm-6 Tumor Burdon)

| Days Post Tumor Implant | Days Post T Cell Transfer | Empty Vector | OT-001407 | OT-001356 | OT-001357 | OT-001895 | OT-001891 |
|---|---|---|---|---|---|---|---|
| 6 | −1 | 1126625 | 1105375 | 1069500 | 1061000 | 1018750 | 1014250 |
| 13 | 6 | 144196250 | 33807500 | 17363750 | 27296250 | 9875000 | 14638750 |
| 20 | 13 | 586616667 | 4186125 | 555500 | 617250 | 544000 | 675125 |
| 27 | 20 | 4346750000 | 49533750 | 769125 | 739625 | 746286 | 805375 |
| 30 | 23 | 12468333333 | 102107500 | ND | ND | ND | ND |
| 34 | 27 | ND | 853425000 | 743125 | 781750 | 822333 | 1073875 |
| 37 | 30 | ND | 5691500000 | ND | ND | ND | ND |
| 41 | 34 | ND | ND | 716750 | 777375 | 838667 | 3199125 |

As shown in Table 28, all secreted and membrane bound IL12 constructs increased CAR-T efficacy, reducing Nalm-6 tumor burden in NSG mice. The mbIL12-PDE5 (OT-001891) construct resulted in a less durable response than the constitutive mbIL12 construct (OT-001895), likely due to low basal levels of IL12, resulting in lower levels of plasma IFNgamma, and lower CAR-T expansion with the regulated construct (Tables 31 & 32).

Percent survival was also measured for each group during the course of the experiment and the following numbers were obtained as shown in Table 29:

TABLE 29

Kaplan-Meier Analysis of Animal Survival: Proportion of survival post tumor implant (%)

| Days Post Tumor Implant | Empty Vector | OT-001407 | OT-001356 | OT-001357 | OT-001895 | OT-001891 |
|---|---|---|---|---|---|---|
| 0 | 100 | 100 | 100 | 100 | 100 | 100 |
| 29 | | | | | | |
| 30 | 50 | | | | | |
| 34 | | 87.5 | | 87.5 | | |
| 37 | 12.5 | 37.5 | | | | |
| 41 | 0 | 25.0 | 50.0 | | 50.0 | |
| 43 | | 25.0 | 50.0 | 87.5 | 50.0 | 100 |

As shown in Table 29, all secreted and membrane bound IL12 constructs increased animal survival.

TABLE 30

| Days Post Tumor Implant | Empty Vector | OT-001407 | OT-001356 | OT-001357 | OT-001895 | OT-001891 |
|---|---|---|---|---|---|---|
| 6 | 21.55 | 21.475 | 19.6125 | 20.7125 | 21.175 | 20.65 |
| 13 | 22.175 | 22.1 | 20.5125 | 21.175 | 21.9625 | 21.1125 |
| 20 | 22.125 | 22.1625 | 20.5875 | 21.4125 | 22.0375 | 21.45 |
| 27 | 23.425 | 23.2 | 22.2125 | 23.1625 | 23.4625 | 22.8625 |
| 34 | 24.45 | 23.725 | 21.8875 | 22.575 | 22.525 | 23.2625 |
| 41 | ND | 23.7 | 19.92857 | 22.01429 | 19.3375 | 22.9125 |

As shown in Table 30, animals receiving CAR-T cells expressing secreted or constitutive membrane bound IL12 constructs had some body weight loss as well as some clinical signs of GVHD (not shown) at late timepoints. The amount of body weight loss appeared to correlate with the levels of plasma IL12 detected at earlier timepoints (Table 31). In particular, the regulated mbIL12-PDE5 (OT-001891) construct, which generated the lowest level of plasma IL12, did not have any body weight loss or clinical signs of GVHD.

TABLE 31

Plasma IL12 and IFNgamma Cytokine Levels Correlate with Construct Efficacy

| Days post T cell transfer & Plasma Cytokine (pg/mL) | Cell Dose (×10e6) | Empty Vector Empty Vector | OT-001407 | OT-001356 | OT-001357 | OT-001895 | OT-001891 |
|---|---|---|---|---|---|---|---|
| Day 14 Plasma IL 12 Levels | 0.3 | Not done | 0 | 1,455 | 86,995 | 2,916 | 6.43 |
|  | 1 | 0 | 0 | 3,853 | 273,593 | 12,663 | 12.5 |
| Day 14 Plasma IFNgamma Levels | 0.3 | Not done | 130 | 17,565 | 18,464 | 57,120 | 1,160 |
|  | 1 | 0 | 47 | 22,154 | 45,845 | 28,163 | 3,088 |

As shown in Table 31, all secreted and membrane bound IL12 constructs increased plasma IL12 and IFNgamma levels, with the lowest cytokine levels detected in animals receiving the regulated mbIL12-PDE5 (OT-001891) construct. Thus, anti-tumor efficacy (Table 28) appears to correlate with plasma cytokine levels.

TABLE 32

Membrane Bound IL12 Constructs Induce T Cell Expansion in Cis and Trans

| Days post T cell transfer & Cell Numbers in 50 uL Blood | Cell Dose (×10e6) | Empty Vector | OT-001407 | OT-001356 | OT-001357 | OT-001895 | OT-001891 |
|---|---|---|---|---|---|---|---|
| Trans Effect: Numbers of GFP+ Cells on Day 14 | 0.3 | Not done | 37.80 | 400.00 | 181.10 | 287.91 | 326.15 |
|  | 1 | 65.93 | 40.00 | 332.75 | 276.04 | 328.79 | 208.79 |
| Cis Effect: Numbers of CAR+ Cells on Day 14 | 0.3 | Not done | 0.88 | 1402.64 | 1741.54 | 270.77 | 24.18 |
|  | 1 | 2.64 | 8.79 | 3789.89 | 7232.53 | 877.36 | 37.36 |

As shown in Table 32, all secreted and membrane bound IL12 constructs increased GFP+(IL12 negative) T cell expansion in cis, and CAR-T cell expansion in trans, with the lowest CAR-T expansion levels detected in animals receiving the regulated mbIL12-PDE5 (OT-001891) construct. Thus, anti-tumor efficacy (Table 28) appears to correlate with CAR-T cell expansion.

Example 10. In Vivo Efficacy and Phenotype Assessment for Membrane Bound IL12 Containing B7.1 Transmembrane (TM) Domains within CD19-CAR T Cells The study was designed to determine if membrane bound IL12 displayed on by CAR-T cells via either a CD8 TM domain and CD8 Hinge region or by a B7.1 TM domain with various hinge regions promote CAR T cell expansion in cis, non-CAR-T cell expansion in trans, and increase in vivo CAR T cell efficacy against CD19+ Nalm6 tumors. To test in vivo anti-tumor activity, experiments were performed in NSG mice. Nalm6 cells were transfected with Redifect Red-Fluc (Perkin Elmer) under selection using Puromycin for ~2 months to generate a line that stably expresses the luciferase reporter; thereafter named Nalm6-Luc. Ten days before tumor implantation, Nalm6-Luc cells were thawed and cultured in puromycin-containing media. On day 0, cells were counted, resuspended in PBS and injected into NSG mice via tail vein. On day 6, mice were imaged for bioluminescent intensity (BLI) and sorted into groups based on their tumor size ensure that all groups had the same sized tumors. Human T cells were transduced with one of the following constructs as shown in the study design in Table 33:

TABLE 33

In Vivo Study Design

| Group | Mice (n) | CAR-T Cells (x10$^6$) | GFP+ Cells (x10$^6$) | Vector Name | Construct Description |
|---|---|---|---|---|---|
| 1 | 8 | 0 | 10 | Empty Vector | Empty Vector |
| 2 | 8 | 1 | 10 | OT-001407 | CD19-CAR alone |
| 3 | 8 | 1 | 10 | OT-001356 | CD19car-IRES-IL 12 |
| 4 | 8 | 1 | 10 | OT-001357 | CD19car-P2A-IL12 |

TABLE 33-continued

In Vivo Study Design

| Group | Mice (n) | CAR-T Cells (x10$^6$) | GFP+ Cells (x10$^6$) | Vector Name | Construct Description |
|---|---|---|---|---|---|
| 5 | 8 | 1 | 10 | OT-001895 | CD19car-P2A-CD8Hinge/TM-IL12 |
| 6 | 8 | 1 | 10 | OT-002011 | CD19car-P2A-sCD8Hinge/B7-1TM-IL12 |
| 7 | 8 | 1 | 10 | OT-002111 | CD19car-P2A-B7-1 C2/TM-IL12 |
| 8 | 8 | 1 | 10 | OT-002096 | CD19car-P2A-IgG1 CH2-CH3/B7-1TM-IL12 |

Next, holding total CAR+ T cell dose constant at 1 million cells per animal, transduced T cells were intravenously infused into mice on day 7. Tumors were monitored in mice using BLI and the mean of the Total Flux (photons/second) was calculated for each group as an indicator of tumor burden (Table 34). In order to track the trans effect of IL12 expressing CART cells on that lack expression of IL12, 10 million GFP+ T cells (negative for IL12) were co-infused with the IL12-expressing CAR+ T cells, and peripheral blood draws taken over time to evaluate the effect of IL12 on phenotypic changes in GFP+ T cells by flow cytometry analysis.

TABLE 34

Mean Total Flux (Nalm-6 Tumor Burdon)

| Days Post Tumor Implant | Days Post T Cell Transfer | Empty Vector | OT-001407 | OT-001356 | OT-001357 | OT-001895 | OT-002011 | OT-002111 | OT-002096 |
|---|---|---|---|---|---|---|---|---|---|
| 6 | −1 | 2755000 | 2715000 | 2667500 | 2627500 | 2610000 | 2612500 | 2612500 | 2616250 |
| 15 | 8 | 1000892500 | 3303000 | 72220000 | 7226250 | 87240250 | 193375000 | 350820000 | 940512500 |
| 19 | 12 | 2715250000 | 1515625 | 3141750 | 853750 | 21203750 | 1850875 | 145548750 | 1916600000 |
| 22 | 15 | 3572500000 | 1282875 | 1001125 | 859250 | 877250 | 1051000 | 20374375 | 1503250000 |
| 27 | 20 | 9614125000 | 1283125 | 991750 | 839625 | 849500 | 1165625 | 2599500 | 2990625000 |
| 30 | 23 | 9107500000 | 1315375 | 797000 | 704625 | 750000 | 1162500 | 1515000 | 3275625000 |
| 33 | 26 | — | 8477500 | 887000 | 810125 | 1365125 | 1213875 | 5421250 | 1730614286 |
| 36 | 29 | — | 29529000 | 627875 | 698875 | 1893857.14 | 2278625 | 2282750 | 1016862857 |
| 41 | 34 | — | 378217125 | 697500 | 767250 | 5758571.43 | 1587125 | 9206250 | 4343828571 |

As shown in Table 34, all secreted and membrane bound IL12 constructs increased CAR-T efficacy, reducing Nalm-6 tumor burden in NSG mice, except the construct with the least level of shed-IL12 (OT-002096). Membrane bound IL12 constructs with the highest levels of shed IL12 (OT-001895, OT-002011, OT-002111) showed a more durable response of anti-tumor efficacy than CAR-T cells lacking IL12.

Percent survival was also measured for each group during the course of the experiment and the following numbers were obtained as shown in Table 35:

TABLE 35

Kaplan-Meier Analysis of Animal Survival

| Days Post Tumor Implant | Empty Vector | OT-001407 | OT-001356 | OT-001357 | OT-001895 | OT-002011 | OT-002111 | OT-002096 |
|---|---|---|---|---|---|---|---|---|
| 0 | 100 | 100 | 100 | 100 | 100 | 100 | 100 | 100 |
| 27 | 50 | | | | | | | |
| 30 | 37.5 | | | | | | | 87.5 |
| 31 | 25 | | | | | | | |
| 32 | 0 | | | | | | | |

TABLE 35-continued

Kaplan-Meier Analysis of Animal Survival

| Days Post Tumor Implant | Empty Vector | OT-001407 | OT-001356 | OT-001357 | OT-001895 | OT-002011 | OT-002111 | OT-002096 |
|---|---|---|---|---|---|---|---|---|
| 33 | | | | | 87.5 | | | |
| 41 | | 100 | 100 | 100 | 75 | 100 | 100 | 87.5 |

As shown in Table 35, all secreted and membrane bound IL12 constructs increased animal survival.

TABLE 36

Plasma Cytokine Levels Correlate with Construct Efficacy

| Days post T cell transfer & Plasma Cytokine (pg/mL) | Empty Vector | OT-001407 | OT-001356 | OT-001357 | OT-001895 | OT-002011 | OT-002111 | OT-002096 |
|---|---|---|---|---|---|---|---|---|
| Day 14 Plasma IL 12 Levels | 0 | 1 | 2,434 | 319,235 | 9,349 | 773 | 839 | 40 |
| Day 14 Plasma IFNgamma Levels | 78 | 652 | 13,344 | 22,130 | 12,862 | 16,508 | 12,970 | 2,902 |
| Day 14 Plasma IL10 Levels | 0 | 0 | 6.9 | 29.6 | 8.3 | 11.2 | 13.7 | 7.8 |

As shown in Table 36, all secreted and membrane bound IL12 constructs increased plasma IL12 and IFNgamma levels, with the lowest cytokine levels detected in animals receiving the mbIL12 construct with the least levels of IL12 shedding (OT-002096). Thus, anti-tumor efficacy (Table 34) appears to correlate with plasma IL12 and IFNgamma levels.

TABLE 37

Membrane Bound IL12 Constructs Induce T Cell Expansion in Cis and in Trans:

| Days post T cell transfer & Plasma Cytokine (pg/mL) | Empty Vector | OT-001407 | OT-001356 | OT-001357 | OT-001895 | OT-002011 | OT-002111 | OT-002096 |
|---|---|---|---|---|---|---|---|---|
| Trans Effect: Numbers of GFP+ Cells on Day 14 | 31 | 27 | 99 | 131 | 90 | 119 | 31 | 96 |
| Cis Effect: Numbers of CAR+ Cells on Day 14 | 2 | 60 | 1777 | 7965 | 889 | 1006 | 104 | 16 |

As shown in Table 37, all secreted and membrane bound IL12 constructs increased GFP+ (IL12 negative) T cell expansion in cis, and CAR-T cell expansion in trans, with the lowest CAR-T expansion levels detected in animals receiving the mbIL12 construct with the least levels of IL12 shedding (OT-002096). Thus, anti-tumor efficacy (Table 34) appears to correlate with CAR-T cell expansion.

While the present disclosure has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the disclosure.

All publications, patent applications, patents, and other references mentioned herein are incorporated by reference in their entirety. In case of conflict, the present specification, including definitions, will control. In addition, section headings, the materials, methods, and examples are illustrative only and not intended to be limiting.

SEQUENCE LISTING (673 sequences)

SEQ ID NO: 1 - protein, 875 aa, Homo sapiens
MERAGPSFGQQRQQQQPQQQKQQQRDQDSVEAWLDDHWDFTFSYFVRKATREMVNAWFAERVHTIPVCKEGIRGHTESCSCPLQQSPRADNSAPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 2 - protein, 519 aa, Homo sapiens
MDDHVTIRKKHLQRPIFRLRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQEARTSSQKCEFIHQ

SEQ ID NO: 3 - protein, 536 aa, Homo sapiens
MELSPRSPPEMLEESDCPSPLELKSAPSKKMWIKLRSLLRYMVKQLENGEINIEELKKNLEYTASLLEAVYIDETRQILDTEDELQELRSDAVPSEVRDWLASTFTQQARAKGRRAEEKPKFRSIVHAVQAGIFVERMFRRTYTSVGPTYSTAVLNCLKNLDLWCFDVFSLNQAADDHALRTIVFELLTRHNLISRFKIPTVFLMSFLDALETGYGKYKNPYHNQIHAADVTQTVHCFLLRTGMVHCLSEIELLAIIFAAAIHDYEHTGTTNSFHIQTKSECAIVYNDRSVLENHHISSVFRLMQDDEMNIFINLTKDEFVELRALVIEMVLATDMSCHFQQVKTMKTALQQLERIDKPKALSLLLHAADISHPTKQWLVHSRWTKALMEEFFRQGDKEAELGLPFSPLCDRTSTLVAQSQIGFIDFIVEPTFSVLTDVAEKSVQPLADEDSKSKNQPSFQWRQPSLDVEVGDPNPDVVSFRSTWVKRIQENKQKWKERAASGITNQMSIDELSPCEEEAPPSPAEDEHNQNGNLD

SEQ ID NO: 4 - protein, 709 aa, Homo sapiens
MESPTKEIEEFESNSLKYLQPEQIEKIWLRLRGLRKYKKTSQRLRSLVKQLERGEASVVDLKKNLEYAATVLESVYIDETRRLLDTEDELSDIQSDAVPSEVRDWLASTFTRQMGMMLRRSDEKPRFKSIVHAVQAGIFVERMYRRTSNMVGLSYPPAVIEALKDVDKWSFDVFSLNEASGDHALKFIFYELLTRYDLISRFKIPISALVSFVEALEVGYSKHKNPYHNLMHAADVTQTVHYLLYKTGVANWLTELEIFAIIFSAAIHDYEHTGTTNNFHIQTRSDPAILYNDRSVLENHHLSAAYRLLQDDEEMNILINLSKDDWREFRTLVIEMVMATDMSCHFQQIKAMKTALQQPEAIEKPKALSLMLHTADISHPAKAWDLHHRWTMSLLEEFFRQGDREAELGLPFSPLCDRKSTMVAQSQVGFIDFIVEPTFTVLTDMTEKIVSPLIDETSQTGGTGQRRSSLNSISSSDAKRSGVKTSGSEGSAPINNSVISVDYKSFKATWTEVVHINRERWRAKVPKEEKAKKEAEEKARLAAEEQQKEMEAKSQAEEGASGKAEKKTSGETKNQVNGTRANKSDNPRGKNSKAEKSSGEQQQNGDFKDGKNKTDKKDHSNIGNDSKKTDGTKQRSHGSPAPSTSSTCRLTLPVIKPPLRHFKRPAYASSSYAPSVSKKTDEHPARYKMLDQRIKMKKIQNISHNWNRK

SEQ ID NO: 5 - protein, 941 aa, Homo sapiens
MGQACGHSILCRSQQYPAARPAEPRGQQVFLKPDEPPPPPQPCADSLQDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 6 - protein, 1141 aa, Homo sapiens
MAVPGDAARVRDKPVHSGVSQAPTAGRDCHHRADPASPRDSGCRGCWGDLVLQPLRSSRKLSSALCAGSLSFLLALLVRLVRGEVGCDLEQCKEAAAAEEEEAAPGAEGGVFPGPRGGAPGGGARLSPWLQPSALLFSLLCAFFWMGLYLLRAGVRLPLAVALLAACCGGEALVQIGLGVGEDHLLSLPAAGVVLSCLAAATWLVLRLRLGVLMIALTSAVRTVSLISLERFKVAWRPYLAYLAGVLGILLARYVEQILPQSAEAAPREHLGSQLIAGTKEDIPVFKRRRRSSSVVSAEMSGCSSKSHRRTSLPCIPREQLMGHSEWDHKRGPRGSQSSGTSITVDIAVMGEAHGLITDLLADPSLPPNVCTSLRAVSNLLSTQLTFQAIHKPRVNPVTSLSENYTCSDSEESSEKDKLAIPKRLRRSLPPGLLRRVSSTWTTTTSATGLPTLEPAPVRRDRSTSIKLQEAPSSSPDSWNNPVMMTLTKSRSFTSSYAISAANHVKAKKQSRPGALAKISPLSSPCSSPLQGTPASSLVSKISAVQFPESADTTAKQSLGSHRALTYTQSAPDLSPQILTPPVICSSCGRPYSQGNPADEPLERSGVATRTPSRTDDTAQVTSDYETNNNSDSSDIVQNEDETECLREPLRKASACSTYAPETMMFLDKPILAPEPLVMDNLDSIMEQLNTWNFPIFDLVENIGRKCGRILSQVSYRLFEDMGLFEAFKIPIREFMNYFHALEIGYRDIPYHNRIHATDVLHAVWYLTTQPIPGLSTVINDHGSTSDSDSDSGFTHGHMGYVFSKTYNVTDDKYGCLSGNIPALELMALYVAAAMHDYDHPGRTNAFLVATSAPQAVLYNDRSVLENHHAAAAWNLFMSRPEYNFLINLDHVEFKHFRFLVIEAILATDLKKHFDFVAKFNGKVNDDVGIDWTNENDRLLVCQMCIKLADINGPAKCKELHLQWTDGIVNEFYEQGDEEASLGLPISPFMDRSAPQLANLQESFISHIVGPLCNSYDSAGLMPGKWVEDSDESGDTDDPEEEEEEAPAPNEEETCENNESPKKKTFKRRKIYCQITQHLLQNHKMWKKVIEEEQRLAGIENQSLDQTPQSHSSEQIQAIKEEEEEKGKPRGEEIPTQKPDQ

SEQ ID NO: 7 - protein, 1112 aa, Homo sapiens
MRRDERDAKAMRSLQPPDGAGSPPESLRNGYVKSCVSPLRQDPPRGFFFHLCRFCNVELRPPPASPQQPRRCSPFCRARLSLGALAAFVLALLLGAEPESWAAGAAWLRTLLSVCSHSLSPLFSIACAFFFLTCFLTRTKRGPGPGRSCGSWWLLALPACCYLGDFLVWQWWSWPWGDGDAGSAAPHTPPEAAAGRLLLVLSCVGLLLTLAHPLRLRHCVLVLLLASFVWWVSFTSLGSLPSALRPLLSGLVGGAGCLLALGLDHFFQIREAPLHPRLSSAAEEKVPVIRPRRRSSCVSLGETAASYYGSCKIFRRPSLPCISREQMILWDWDLKQWYKPHYQNSGGGNGVDLSVLNEARNMVSDLLTDPSLPPQVISSLRSISSLMGAFSGSCRPKINPLTPFPGFYPCSEIEDPAEKGDRKLNKGLNRNSLPTPQLRRSSGTSGLLPVEQSSRWDRNNGKRPHQEFGISSQGCYLNGPFNSNLLTIPKQRSSSVSLTHHVGLRRAGVLSSLSPVNSSNHGPVSTGSLTNRSPIEFPDTADFLNKPSVILQRSLGNAPNTPDFYQQLRNSDSNLCNSCGHQMLKYVSTSESDGTDCCSGKSGEEENIFSKESFKLMETQQEEETEKKDSRKLFQEGDKWLTEEAQSEQQTNIEQEVSLDLILVEEYDSLIEKMSNWNFPIFELVEKMGEKSGRILSQVMYTLFQDTGLLEIFKIPTQQFMNYFRALENGYRDIPYHNRIHATDVLHAVWYLTTRPVPGLQQIHNGCGTGNETDSDGRINHGRIAYISSKSCSNPDESYGCLSSNIPALELMALYVAAAMHDYDHPGRTNAFLVATNAPQAVLYNDRSVLENHHAASAWNLYLSRPEYNFLLHLDHVEFKRFRFLVIEAILATDLKKHFDFLAEFNAKANDVNSNGIEWSNENDRLLVCQVCIKLADINGPAKVRDLHLKWTEGIVNEFYEQGDEEANLGLPISPFMDRSSPQLAKLQESFITHIVGPLCNSYDAAGLLPGQWLEAEEDNDTESGDDEDGEELDTEDEEMENNLNPKPPRRKSRRRIFCQLMHHLTENHKIWKEIVEEEEKCKADGNKLQVENSSLPQADEIQVIEEADEEE

SEQ ID NO: 8 - protein, 886 aa, Homo sapiens
MEPPTVPSERSLSLSLPGPREGQATLKPPPQHLWRQPRTPIRIQQRGYSDSAERAERERQPHRPIERADAMDTSDRPGLRTTRMSWPSSFHGTGTGSGGAGGGSSRRFEAENGPTPSPGRSPLDSQASPGLVLHAGAATSQRRESFLYRSDSDYDMSPKTMSRNSSVTSEAHAEDLIVTPFAQVLASLRSVRSNFSLLTNVPVPSNKRSPLGGPTPVCKATLSEETCQQLARETLEELDWCLEQLETMQTYRSVSEMASHKFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 9 - protein, 736 aa, Homo sapiens
MKKSRSVMTVMADDNVKDYFECSLSKSYSSSSNTLGIDLWRGRRCCSGNLQLPPLSQRQSERARTPEGDGISRPTTLPLTTLPSIAITTVSQECFDVENGPSPGRSPLDPQASSSAGLVLHATFPGHSQRRESFLYRSDSDYDLSPKAMSRNSSLPSEQHGDDLIVTPFAQVLASLRSVRNNFTILTNLHGTSNKRSPAASQPPVSRVNPQEESYQKLAMETLEELDWCLDQLETIQTYRSVSEMASNKFKRMLNRELTHLSEMSRSGNQVSEYISNTFLDKQNDVEIPSPTQKDREKKKKQQLMTQISGVKKLMHSSSLNNTSISRFGVNTENEDHLAKELEDLNKWGLNIFNVAGYSHNRPLTCIMYAIFQERDLLKTFRISSDTFITYMMTLEDHYHSDVAYHNSLHAADVAQSTHVLLSTPALDAVFTDLEILAAIFAAAIHDVDHPGVSNQFLINTNSELALMYNDESVLENHHLAVGFKLLQEEHCDIFMNLTKKQRQTLRKMVIDMVLATDMSKHMSLLADLKTMVETKKVTSSGVLLLDNYTDRIQVLRNMVHCADLSNPTKSLELYRQWTDRIMEEFFQQGDKERERGMEISPMCDKHTASVEKSQVGFIDYIVHPLWETWADLVQPDAQDILDTLEDNRNWYQSMIPQSPSPPLDEQNRDCQGLMEKFQFELTLDEEDSEGPEKEGEGHSYFSSTKTLCVIDPENRDSLGETDIDIATEDKSPVDT

SEQ ID NO: 10 - protein, 712 aa, Homo sapiens
MENLGVGEGAEACSRLSRSRGRHSMTRAPKHLWRQPRRPIRIQQRFYSDPDKSAGCRERDLSPRPELRKSRLSWPVSSCRRFDLENGLSCGRRALDPQSSPGLGRIMQAPVPHSQRRESFLYRSDSDYELSPKAMSRNSSVASDLHGEDMIVTPFAQVLASLRTVRSNVAALARQQCLGAAKQGPVGNPSSSNQLPPAEDTGQKLALETLDELDWCLDQLETLQTRHSVGEMASNKFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 11 - protein, 809 aa, Homo sapiens
MEAEGSSAPARAGSGEGSDSAGGATLKAPKHLWRHEQHHQYPLRQPQFRLLHPHHHLPPPPPPSPQPQPQCPLQPPPPPPLPPPPPPPGAARGRYASSGATGRVRHRGYSDTERYLYCRAMDRTSYAVETGHRPGLKKSRMSWPSSFQGLRRFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 12 - protein, 860 aa, Homo sapiens
MGEVTAEEVEKFLDSNIGFAKQYYNLHYRAKLISDLLGAKEAAVDFSNYHSPSSMEESEIIFDLLRDFQENLQTEKCIFNVMKKLCFLLQADRMSLFMYRTRNGIAELATRLFNVHKDAVLEDCLVMPDQEIVFPLDMGIVGHVAHSKKIANVPNTEEDEHFCDFVDILTEYKTKNILASPIMNGKDVVAIIMAVNKVDGSHFTKRDEEILLKYLNFANLIMKVYHLSYLHNCETRRGQILLWSGSKVFEELTDIERQFHKALYTVRAFLNCDRYSVGLLDMTKQKEFFDVWPVLMGEVPPYSGPRTPDGREINFYKVIDYILHGKEDIKVIPNPPPDHWALVSGLPAYVAQNGLICNIMNAPAEDFFAFQKEPLDESGWMIKNVLSMPIVNKKEEIVGVATFYNRKDGKPFDEMDETLMESLTQFLGWSVLNPDTYESMNKLENRKDIFQDIVKYHVKCDNEEIQKILKTREVYGKEPWECEEEELAEILQAELPDADKYEINKFHFSDLPLTELELVKCGIQMYYELKVVDKFHIPQEALVRFMYSLSKGYRKITYHNWRHGFNVGQTMFSLLVTGKLKRYFTDLEALAMVTAAFCHDIDHRGTNNLYQMKSQNPLAKLHGSSILERHHLEFGKTLLRDESLNIFQNLNRRQHEHAIHMMDIAIIATDLALYFKKRTMFQKIVDQSKTYESEQEWTQYMMLEQTRKEIVMAMMMTACDLSAITKPWEVQSQVALLVAAEFWEQGDLERTVLQQNPIPMMDRNKADELPKLQVGFIDFVCTFVYKEFSRFHEEITPMLDGITNNRKEWKALADEYDAKMKVQEEKKQKQQSAKSAAAGNQPGGNPSPGGATTSKSCCIQ

SEQ ID NO: 13 - protein, 854 aa, Homo sapiens
MSLSEEQARSFLDQNPDFARQYFGKKLSPENVAAACEDGCPPDCDSLRDLCQVEESTALLELVQDMQESINMERVVFKVLRRLCTLLQADRCSLFMYRQRNGVAELATRLFSVQPDSVLEDCLVPPDSEIVFPLDIGVVGHVAQTKKMVNVEDVAECPHFSSFADELTDYKTKNMLATPIMNGKDVVAVIMAVNKLNGPFFTSEDEDVFLKYLNFATLYLKIYHLSYLHNCETRRGQVLLWSANKVFEELTDIERQFHKAFYTVRAYLNCERYSVGLLDMTKEKEFFDVWSVLMGESQPYSGPRTPDGREIVFYKVIDYVLHGKEEIKVIPTPSADHWALASGLPSYVAESGFICNIMNASADEMFKFQEGALDDSGWLIKNVLSMPIVNKKEEIVGVATFYNRKDGKPFDEQDEVLMESLTQFLGWSVMNTDTYDKMNKLENRKDIAQDMVLYHVKCDRDEIQLILPTRARLGKEPADCDEDELGEILKEELPGPTTFDIYEFHFSDLECTELDLVKCGIQMYYELGVVRKFQIPQEVLVRFLFSISKGYRRITYHNWRHGFNVAQTMFTLLMTGKLKSYYTDLEAFAMVTAGLCHDIDHRGTNNLYQMKSQNPLAKLHGSSILERHHLEFGKFLLSEETLNIYQNLNRRQHEHVIHLMDIAIIATDLALYFKKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYKEFSRFHEEILPMFDRLQNNRKEWKALADEYEAKVKALEEKEEEERVAAKKVGTEICNGGPAPKSSTCCIL

SEQ ID NO: 14 - protein, 858 aa, Homo sapiens
MGEINQVAVEKYLEENPQFAKEYFDRKLRVEVLGEIFKNSQVPVQSSMSFSELTQVEESALCLELLWTVQEEGGTPEQGVHRALQRLAHLLQADRCSMFLCRSRNGIPEVASRLLDVTPTSKFEDNLVGPDKEVVFPLDIGIVGWAAHTKKTHNVPDVKKNSHFSDFMDKQTGYVTKNLLATPIVVGKEVLAVIMAVNKVNASEFSKQDEEVFSKYLNFVSIILRLHHTSYMYNIESRRSQILMWSANKVFEELTDVERQFHKALYTVRSYLNCERYSIGLLDMTKEKEFYDEWPIKLGEVEPYKGPKTPDGREVNFYKIIDYILHGKEEIKVIPTPPADHWTLISGLPTYVAENGFICNMMNAPADEYFTFQKGPVDETGWVIKNVLSLPIVNKKEDIVGVATFYNRKDGKPFDEHDEYITETLTQFLGWSLLNTDTYDKMNKLENRKDIAQEMLMNQTKATPEEIKSILKFQEKLNVDVIDDCEEKQLVAILKEDLPDPRSAELYEFRFSDFPLTEHGLIKCGIRLFFEINVVEKFKVPVEVLTRWMYTVRKGYRAVTYHNWRHGFNVGQTMFTLLMTGRLKKYYTDLEAFAMLAAAFCHDIDHRGTNNLYQMKSTSPLARLHGSSILERHHLEYSKTLLQDESLNIFQNLNKRQFETVIHLFEVAIIATDLALYFKKRTMFQKIVDACEQMQTEEEAIKYVTVDPTKKEIIMAMMMTACDLSAITKPWEVQSQVALMVANEFWEQGDLERTVLQQQPIPMMDRNKRDELPKLQVGFIDFVCTFVYKEFSRFHKEITPMLSGLQNNRVEWKSLADEYDAKMKVIEEEAKKQEGGAEKAAEDSGGGDDKKSKTCLML

SEQ ID NO: 15 - protein, 482 aa, Homo sapiens
MEVCYQLPVLPLDRPVPQHVLSRRGAISFSSSSALFGCPNPRQLSQRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASWKGLQREQSSSEDTDAAFELNSQLLPQENRLS

SEQ ID NO: 16 - protein, 450 aa, Homo sapiens
MSCLMVERCGEILFENPDQNAKCVCMLGDIRLRGQTGVRAERRGSYPFIDFRLLNSTTYSGEIGTKKKVKRLLSFQRYFHASRLLRGIIPQAPLHLLDEDYLGQARHMLSKVGMWDFDIFLFDRLTNGNSLVTLLCHLFNTHGLIHHFKLDMVTLHRFLVMVQEDYHSQNPYHNAVHAADVTQAMHCYLKEPKLASFLTPLDIMLGLLAAAAHDVDHPGVNQPFLIKTNHHLANLYQNMSVLENHHWRSTIGMLRESRLLAHLPKEMTQDIEQQLGSLILATDINRQNEFLTRLKAHLHNKDLRLEDAQDRHFMLQIALKCADICNPCRIWEMSKQWSERVCEEFYRQGELEQKFELEISPLCNQQKDSIPSIQIGFMSYIVEPLFREWAHFTGNSTLSENMLGHLAHNKAQWKSLLPRQHRSRGSSGSGPDHDHAGQGTESEEQEGDSP

SEQ ID NO: 17 - protein, 829 aa, Homo sapiens
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQYANPAFETTMGYQSGELIGKELGEVPINEKKADLLDTINSCIRIGKEWQGIYYAKKKNGDNIQQNVKIIPVIGQGGKIRHYVSIIRVCNGNNKAEKISECVQSDTHTDNQTGKHKDRRKGSLDVKAVASRATEVSSQRRHSSMARIHSMTIEAPITKVINIINAAQESSPMPVTEALDRVLEILRTTELYSPQFGAKDDDPHANDLVGGLMSDGLRRLSGNEYVLSTKNTQMVSSNIITPISLDDVPPRIARAMENEEYWDFDIFELEAATHNRPLIYLGLKMFARFGICEFLHCSESTLRSWLQIIEANYHSSNPYHNSTHSADVLHATAYFLSKERIKETLDPIDEVAALIAATIHDVDHPGRTNSFLCNAGSELAILYNDTAVLESHHAALAFQLTTGDDKCNIFKNMERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYWKGLDEMKLRNLRPPPE

SEQ ID NO: 18 - protein, 885 aa, Homo sapiens
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQYVNPAFERMMGYHKGELLGKELADLPKSDKNRADLLDTINTCIKKGKEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 19 - protein, 593 aa, Homo sapiens
MGSGSSSYRPKAIYLDIDGRIQKVIFSKYCNSSDIMDLFCIATGLPRNTTISLLTTDDAMVSIDPTMPANSERTPYKVRPVAIKQLSAGVEDKRTTSRGQSAERPLRDRRVVGLEQPRREGAFESGQVEPRPREPQGCYQEGQRIPPEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 20 - protein, 779 aa, Homo sapiens
MRIEERKSQHLTGLTDEKVKAYLSLHPQVLDEFVSESVSAETVEKWLKRKNNKSEDESAPKEVSRYQDTNMQGVVYELNSYIEQRLDTGGDNQLLLYELSSIIKIATKADGFALYFLGECNNSLCIFTPPGIKEGKPRLIPAGPITQGTTVSAYVAKSRKTLLVEDILGDERFPRGTGLESGTRIQSVLCLPIVTAIGDLIGILELYRHWGKEAFCLSHQEVATANLAWASVAIHQVQVCRGLAKQTELNDFLLDVSKTYFDNIVAIDSLLEHIMIYAKNLVNADRCALFQVDHKNKELYSDLFDIGEEKEGKPVFKKTKEIRFSIEKGIAGQVARTGEVLNIPDAYADPRFNREVDLYTGYTTRNILCMPIVSRGSVIGVVQMVNKISGSAFSKTDENNFKMFAVFCALALHCANMYHRIRHSECIYRVTMEKLSYHSICTSEEWQGLMQFTLPVRLCKEIELFHFDIGPFENMWPGIFVYMVHRSCGTSCFELEKLCRFIMSVKKNYRRVPYHNWKHAVTVAHCMYAILQNNHTLFTDLERKGLLIACLCHDLDHRGFSNSYLQKFDHPLAALYSTSTMEQHHFSQTVSILQLEGHNIFSTLSSSEYEQVLEIIRKAIIATDLALYFGNRKQLEEMYQTGSLNLNNQSHRDRVIGLMMTACDLCSVTKLWPVTKLTANDIYAEFWAEGDEMKKLGIQPIPMMDRDKKDEVPQGQLGFYNAVAIPCYTTLTQILPPTEPLLKACRDNLSQWEKVIRGEETATWISSPSVAQKAAASED

SEQ ID NO: 21 - protein, 933 aa, Homo sapiens
MAASRLDFGEVETFLDRHPELFEDYLMRKGKQEMVEKWLQRHSQGQGALGPRPSLAGTSSLAHSTCRGGSSVGGGTGPNGSAHSQPLPGGGDCGGVPLSPSWAGGSRGDGNLQRRASQKELRKSFARSKAIHVNRTYDEQVTSRAQEPLSSVRRRALLRKASSLPPTTAHILSALLESRVNLPRYPPTAIDYKCHLKKHNERQFFLELVKDISNDLDLTSLSYKILIFVCLMVDADRCSLFLVEGAAAGKKTLVSKFFDVHAGTPLLPCSSTENSNEVQVPWGKGIIGYVGEHGETVNIPDAYQDRRFNDEIDKLTGYKTKSLLCMPIRSSDGEIIGVAQAINKIPEGAPFTEDDEKVMQMYLPFCGIAISNAQLFAASRKEYERSRALLEVVNDLFEEQTDLEKIVKKIMHRAQTLLKCERCSVLLLEDIESPVVKFTKSFELMSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEAFVIFCGLGINNTIMYDQVKKSWAKQSVALDVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSPASVMVAKEDRN

SEQ ID NO: 22 - protein, 833 aa, Homo sapiens
MLPFGDKTREMVNAWFAERVHTIPVCKEGIRGHTESCSCPLQQSPRADNSAPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 23 - protein, 823 aa, Homo sapiens
MVNAWFAERVHTIPVCKEGIRGHTESCSCPLQQSPRADNSAPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 24 - protein, 643 aa, Homo sapiens
MERAGPSFGQQRQQQQPQQQKQQQRDQDSVEAWLDDHWDFTFSYFVRKATREMVNAWFAERVHTIPVCKEGIRGHTESCSCPLQQSPRADNSAPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQILTSVGID

SEQ ID NO: 25 - protein, 187 aa, Homo sapiens
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 26 - protein, 97 aa, Artificial Sequence [sequence omitted]

SEQ ID NO: 27 - protein, 187 aa, Homo sapiens
MFLLLNCIVAVSQNMGIGKNGDLPRPPLRNEFRYFQRMTTTSSVEGKQNLVIMGRKTWFSIPEKNRPLKDRINLVLSRELKEPPQGAHFLARSLDDALKLTERPELANKVDMIWIVGGSSVYKEAMNHLGHLKLFVTRIMQDFESDTFFSEIDLEKYKLLPEYPGVLSDVQEGKHIKYKFEVCEKDD

SEQ ID NO: 28 - protein, 159 aa, Escherichia coli [sequence omitted]

SEQ ID NO: 29 - protein, 108 aa, Homo sapiens
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 30 - protein, 505 aa, Homo sapiens
MGETLGDSPIDPESDSFTDTLSANISQEMTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 31 - protein, 260 aa, Homo sapiens
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 32 - protein, 231 aa, Homo sapiens
MAGKKVLIVYAHQEPKSFNGSLKNVAVDELSRQGCTVTVSDLYAMNLEPRATDKDITGTLSNPEVFNYGVETHEAYKQRSLASDITDEQKKVREADLVIFQFPLYWFSVPAILKGWMDRVLCQGFAFDIPGFYDSGLLQGKLALLSVTTGGTAEMYTKTGVNGDSRYFLWPLQHGTLHFCGFKVLAPQISFAPEIASEEERKGMVAAWSQRLQTIWKEEPIPCTAHWHFGQ

SEQ ID NO: 33 - protein, 766 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 34 - protein, 595 aa, Homo sapiens [sequence omitted]

SEQ ID NO: 35 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 36 - protein, 296 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYE

SEQ ID NO: 37 - protein, 302 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 38 - protein, 294 aa, Artificial Sequence
  source: /note="Description of Artificial Sequence: Synthetic Destabilizing Domain (DD)"
SDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 39 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 40 - protein, 271 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 41 - protein, 323 aa, Artificial Sequence
  source: /note="Description of Artificial Sequence: Synthetic Destabilizing Domain (DD)"
FKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERW

SEQ ID NO: 42 - protein, 300 aa, Artificial Sequence
  source: /note="Description of Artificial Sequence: Synthetic Destabilizing Domain (DD)"
FKIPTVFLMSFLDALETGYGKYKNPYHNQIHAADVTQTVHCFLLRTGMVHCLSEIELLAIIFAAAIHDYEHTGTTNSFHIQTKSECAIVYNDRSVLENHHISSVFRLMQDDEMNIFINLTKDEFVELRALVIEMVLATDMSCHFQQVKTMKTALQQLERIDKPKALSLLLHAADISHPTKQWLVHSRWTKALMEEFFRQGDKEAELGLPFSPLCDRTSTLVAQSQIGFIDFIVEPTFSVLTDVAEKSVQPLADEDSKSKNQPSFQWRQPSLDVEVGDPNPDVVSFRSTWVKRIQENKQKW

SEQ ID NO: 43 - protein, 320 aa, Artificial Sequence
  source: /note="Description of Artificial Sequence: Synthetic Destabilizing Domain (DD)"
FKIPISALVSFVEALEVGYSKHKNPYHNLMHAADVTQTVHYLLYKTGVANWLTELEIFAIIFSAAIHDYEHTGTTNNFHIQTRSDPAILYNDRSVLENHHLSAAYRLLQDDEEMNILINLSKDDWREFRTLVIEMVMATDMSCHFQQIKAMKTALQQPEAIEKPKALSLMLHTADISHPAKAWDLHHRWTMSLLEEFFRQGDREAELGLPFSPLCDRKSTMVAQSQVGFIDFIVEPTFTVLTDMTEKIVSPLIDETSQTGGTGQRRSSLNSISSSDAKRSGVKTSGSEGSAPINNSVISVDYKSFKATWTEVVHINRERW

SEQ ID NO: 44 - protein, 259 aa, Artificial Sequence
  source: /note="Description of Artificial Sequence: Synthetic Destabilizing Domain (DD)"
KIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASN

SEQ ID NO: 45 - protein, 359 aa, Artificial Sequence
  source: /note="Description of Artificial Sequence: Synthetic Destabilizing Domain (DD)"
FKIPIREFMNYFHALEIGYRDIPYHNRIHATDVLHAVWYLTTQPIPGLSTVINDHGSTSDSDSDSGFTHGHMGYVFSKTYNVTDDKYGCLSGNIPALELMALYVAAAMHDYDHPGRTNAFLVATSAPQAVLYNDRSVLENHHAAAAWNLFMSRPEYNFLINLDHVEFKHFRFLVIEAILATDLKKHFDFVAKFNGKVNDDVGIDWTNENDRLLVCQMCIKLADINGPAKCKELHLQWTDGIVNEFYEQGDEEASLGLPISPFMDRSAPQLANLQESFISHIVGPLCNSYDSAGLMPGKWVEDSDESGDTDDPEEEEEEAPAPNEEETCENNESPKKKTFKRRKIYCQITQHLLQNHKMW

SEQ ID NO: 46 - protein, 360 aa, Artificial Sequence
  source: /note="Description of Artificial Sequence: Synthetic Destabilizing Domain (DD)"
FKIPTQQFMNYFRALENGYRDIPYHNRIHATDVLHAVWYLTTRPVPGLQQIHNGCGTGNETDSDGRINHGRIAYISSKSCSNPDESYGCLSSNIPALELMALYVAAAMHDYDHPGRTNAFLVATNAPQAVLYNDRSVLENHHAASAWNLYLSRPEYNFLLHLDHVEFKRFRFLVIEAILATDLKKHFDFLAEFNAKANDVNSNGIEWSNENDRLLVCQVCIKLADINGPAKVRDLHLKWTEGIVNEFYEQGDEEANLGLPISPFMDRSSPQLAKLQESFITHIVGPLCNSYDAAGLLPGQWLEAEEDNDTESGDDEDGEELDTEDEEMENNLNPKPPRRKSRRRIFCQLMHHLTENHKIW

SEQ ID NO: 47 - protein, 394 aa, Artificial Sequence
  source: /note="Description of Artificial Sequence: Synthetic Destabilizing Domain (DD)"
QPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISM

SEQ ID NO: 48 - protein, 353 aa, Artificial Sequence
  source: /note="Description of Artificial Sequence: Synthetic Destabilizing Domain (DD)"
VNTENEDHLAKELEDLNKWGLNIFNVAGYSHNRPLTCIMYAIFQERDLLKTFRISSDTFITYMMTLEDHYHSDVAYHNSLHAADVAQSTHVLLSTPALDAVFTDLEILAAIFAAAIHDVDHPGVSNQFLINTNSELALMYNDESVLENHHLAVGFKLLQEEHCDIFMNLTKKQRQTLRKMVIDMVLATDMSKHMSLLADLKTMVETKKVTSSGVLLLDNYTDRIQVLRNMVHCADLSNPTKSLELYRQWTDRIMEEFFQQGDKERERGMEISPMCDKHTASVEKSQVGFIDYIVHPLWETWADLVQPDAQDILDTLEDNRNWYQSMIPQSPSPPLDEQNRDCQGLMEKFQFEL

SEQ ID NO: 49 - protein, 366 aa, Artificial Sequence
  source: /note="Description of Artificial Sequence: Synthetic Destabilizing Domain (DD)"
VQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGE

SEQ ID NO: 50 - protein, 366 aa, Artificial Sequence
  source: /note="Description of Artificial Sequence: Synthetic Destabilizing Domain (DD)"
VKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKD

SEQ ID NO: 51 - protein, 337 aa, Artificial Sequence
  source: /note="Description of Artificial Sequence: Synthetic Destabilizing Domain (DD)"
EEEELAEILQAELPDADKYEINKFHFSDLPLTELELVKCGIQMYYELKVVDKFHIPQEALVRFMYSLSKGYRKITYHNWRHGFNVGQTMFSLLVTGKLKRYFTDLEALAMVTAAFCHDIDHRGTNNLYQMKSQNPLAKLHGSSILERHHLEFGKTLLRDESLNIFQNLNRRQHEHAIHMMDIAIIATDLALYFKKRTMFQKIVDQSKTYESEQEWTQYMMLEQTRKEIVMAMMMTACDLSAITKPWEVQSQVALLVAAEFWEQGDLERTVLQQNPIPMMDRNKADELPKLQVGFIDFVCTFVYKEFSRFHEEITPMLDGITNNRKEWKALADEYDAK

SEQ ID NO: 52 - protein, 341 aa, Artificial Sequence
  source: /note="Description of Artificial Sequence: Synthetic Destabilizing Domain (DD)"
PADCDEDELGEILKEELPGPTTFDIYEFHFSDLECTELDLVKCGIQMYYELGVVRKFQIPQEVLVRFLFSISKGYRRITYHNWRHGFNVAQTMFTLLMTGKLKSYYTDLEAFAMVTAGLCHDIDHRGTNNLYQMKSQNPLAKLHGSSILERHHLEFGKFLLSEETLNIYQNLNRRQHEHVIHLMDIAIIATDLALYFKKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYKEFSRFHEEILPMFDRLQNNRKEWKALADEYEAK

SEQ ID NO: 53 - protein, 340 aa, Artificial Sequence
  source: /note="Description of Artificial Sequence: Synthetic Destabilizing Domain (DD)"
DDCEEKQLVAILKEDLPDPRSAELYEFRFSDFPLTEHGLIKCGIRLFFEINVVEKFKVPVEVLTRWMYTVRKGYRAVTYHNWRHGFNVGQTMFTLLMTGRLKKYYTDLEAFAMLAAAFCHDIDHRGTNNLYQMKSTSPLARLHGSSILERHHLEYSKTLLQDESLNIFQNLNKRQFETVIHLFEVAIIATDLALYFKKRTMFQKIVDACEQMQTEEEAIKYVTVDPTKKEIIMAMMMTACDLSAITKPWEVQSQVALMVANEFWEQGDLERTVLQQQPIPMMDRNKRDELPKLQVGFIDFVCTFVYKEFSRFHKEITPMLSGLQNNRVEWKSLADEYDAK

SEQ ID NO: 54 - protein, 265 aa, Artificial Sequence
  source: /note="Description of Artificial Sequence: Synthetic Destabilizing Domain (DD)"
FHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASW

SEQ ID NO: 55 - protein, 239 aa, Artificial Sequence
  source: /note="Description of Artificial Sequence: Synthetic Destabilizing Domain (DD)"
YHNAVHAADVTQAMHCYLKEPKLASFLTPLDIMLGLLAAAAHDVDHPGVNQPFLIKTNHHLANLYQNMSVLENHHWRSTIGMLRESRLLAHLPKEMTQDIEQQLGSLILATDINRQNEFLTRLKAHLHNKDLRLEDAQDRHFMLQIALKCADICNPCRIWEMSKQWSERVCEEFYRQGELEQKFELEISPLCNQQKDSIPSIQIGFMSYIVEPLFREWAHFTGNSTLSENMLGHLAHNK

SEQ ID NO: 56 - protein, 283 aa, Artificial Sequence
  source: /note="Description of Artificial Sequence: Synthetic Destabilizing Domain (DD)"
LHCSESTLRSWLQIIEANYHSSNPYHNSTHSADVLHATAYFLSKERIKETLDPIDEVAALIAATIHDVDHPGRTNSFLCNAGSELAILYNDTAVLESHHAALAFQLTTGDDKCNIFKNMERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYW

SEQ ID NO: 57 - protein, 279 aa, Artificial Sequence
  source: /note="Description of Artificial Sequence: Synthetic Destabilizing Domain (DD)"
LNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHW

SEQ ID NO: 58 - protein, 263 aa, Artificial Sequence
  source: /note="Description of Artificial Sequence: Synthetic Destabilizing Domain (DD)"
FSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRY

SEQ ID NO: 59 - protein, 302 aa, Artificial Sequence
  source: /note="Description of Artificial Sequence: Synthetic Destabilizing Domain (DD)"
CKEIELFHFDIGPFENMWPGIFVYMVHRSCGTSCFELEKLCRFIMSVKKNYRRVPYHNWKHAVTVAHCMYAILQNNHTLFTDLERKGLLIACLCHDLDHRGFSNSYLQKFDHPLAALYSTSTMEQHHFSQTVSILQLEGHNIFSTLSSSEYEQVLEIIRKAIIATDLALYFGNRKQLEEMYQTGSLNLNNQSHRDRVIGLMMTACDLCSVTKLWPVTKLTANDIYAEFWAEGDEMKKLGIQPIPMMDRDKKDEVPQGQLGFYNAVAIPCYTTLTQILPPTEPLLKACRDNLSQWEKVIRGEE

SEQ ID NO: 60 - protein, 266 aa, Artificial Sequence
  source: /note="Description of Artificial Sequence: Synthetic Destabilizing Domain (DD)"
FKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKW

SEQ ID NO: 61 - protein, 135 aa, Artificial Sequence
  source: /note="Description of Artificial Sequence: Synthetic Destabilizing Domain (DD)"
MGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 62 - protein, 129 aa, Artificial Sequence
  source: /note="Description of Artificial Sequence: Synthetic Destabilizing Domain (DD)"
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKIPRCSL

SEQ ID NO: 63 - protein, 107 aa, Artificial Sequence
  source: /note="Description of Artificial Sequence: Synthetic Destabilizing Domain (DD)"
GVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 64 - protein, 189 aa, Artificial Sequence
  source: /note="Description of Artificial Sequence: Synthetic Destabilizing Domain (DD)"
SVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 65 - protein, 245 aa, Artificial Sequence
  source: /note="Description of Artificial Sequence: Synthetic Destabilizing Domain (DD)"
SLALSLTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAHRL

SEQ ID NO: 66 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKFQALAEQQ

SEQ ID NO: 67 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaattccaggcccttgcagaacagcag

SEQ ID NO: 68 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFADAICLQLYEALTHVSEDCFPLLDGCRKNRQKWQALAEQQ

SEQ ID NO: 69 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcgccgatgccatctgcttgcaactgtatgaggccctgacccacgtgtcagaggactgtttccctttgctagatggctgcagaaagaacaggcagaaatggcaggcccttgcagaacagcag

SEQ ID NO: 70 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLAEALTHVSEDCFPLLDGCRKNRQKWQALAEQQ

SEQ ID NO: 71 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactggccgaggccctgacccacgtgtcagaggactgtttccctttgctagatggctgcagaaagaacaggcagaaatggcaggcccttgcagaacagcag

SEQ ID NO: 72 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFADQGDRERKELNIEPTDLMNREKKNKIPSMQVGFIDAICLQLYEALTHVSEDCFPLLDGCRKNRQKWQALAEQQ

SEQ ID NO: 73 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaatttgccgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 74 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFAELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 75 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttgccgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 76 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttgctgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 77 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttgcggaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 78 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALLIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 79 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgctgattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 80 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 81 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 82 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 83 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 84 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggttaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 85 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCIFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 86 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatctttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 87 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLLHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 88 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttgctgcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 89 - protein, 326 aa, Artificial Sequence
  source: /note="Description of Artificial Sequence: Synthetic Destabilizing Domain (DD)"
DETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 90 - protein, 326 aa, Artificial Sequence
  source: /note="Description of Artificial Sequence: Synthetic Destabilizing Domain (DD)"
EGTRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 91 - protein, 326 aa, Artificial Sequence
  source: /note="Description of Artificial Sequence: Synthetic Destabilizing Domain (DD)"
EETRELRSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 92 - protein, 326 aa, Artificial Sequence
  source: /note="Description of Artificial Sequence: Synthetic Destabilizing Domain (DD)"
EETRELQSLAAAVVPSAQTLRITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 93 - protein, 326 aa, Artificial Sequence
  source: /note="Description of Artificial Sequence: Synthetic Destabilizing Domain (DD)"
EETRELQSLAAAVVPSAQTLKITDLSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 94 - protein, 326 aa, Artificial Sequence
  source: /note="Description of Artificial Sequence: Synthetic Destabilizing Domain (DD)"
EETRELQSLAAAVVPSAQTLKITDFSLSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 95 - protein, 326 aa, Artificial Sequence
  source: /note="Description of Artificial Sequence: Synthetic Destabilizing Domain (DD)"
EETRELQSLAAAVVPSAQTLKITDFSFSDLELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 96 - protein, 326 aa, Artificial Sequence
  source: /note="Description of Artificial Sequence: Synthetic Destabilizing Domain (DD)"
EETRELQSLAAAVVPSAQTLKITDFSFSDSELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 97 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMEHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 98 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQSFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 99 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKENYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 100 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRENVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 101 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKHVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 102 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALRAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 103 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGEIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 104 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQSKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 105 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVSNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 106 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgagtaactcttacatacagcgaagtgaacatccacttgcccaactttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggaattgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 107 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLDCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 108 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLNCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 109 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYRHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 110 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCRSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 111 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFAQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 112 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTSLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 113 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATNLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 114 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATGLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 115 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFEHIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 116 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKSQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 117 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTSCDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 118 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACNLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 119 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACGLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 120 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACVLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 121 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLFAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 122 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDREREELNIEPTDLMNREKKNKIPSMQVGFIDAICLQLYEALTHVSEDCFPLLDGCRKNRQKWQALAEQQ

SEQ ID NO: 123 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKEFNIEPTDLMNREKKNKIPSMQVGFIDAICLQLYEALTHVSEDCFPLLDGCRKNRQKWQALAEQQ

SEQ ID NO: 124 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNTEPTDLMNREKKNKIPSMQVGFIDAICLQLYEALTHVSEDCFPLLDGCRKNRQKWQALAEQQ

SEQ ID NO: 125 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPPDLMNREKKNKIPSMQVGFIDAICLQLYEALTHVSEDCFPLLDGCRKNRQKWQALAEQQ

SEQ ID NO: 126 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPCMQVGFIDAICLQLYEALTHVSEDCFPLLDGCRKNRQKWQALAEQQ

SEQ ID NO: 127 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSAQVGFIDAICLQLYEALTHVSEDCFPLLDGCRKNRQKWQALAEQQ

SEQ ID NO: 128 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDATCLQLYEALTHVSEDCFPLLDGCRKNRQKWQALAEQQ

SEQ ID NO: 129 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDSFPLLDGCRKNRQKWQALAEQQ

SEQ ID NO: 130 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQEWQALAEQQ

SEQ ID NO: 131 - protein, 326 aa, Artificial Sequence
  source: /note="Description of Artificial Sequence: Synthetic Destabilizing Domain (DD)"
EETRELQSLAAAVVPSAQTLKITDFGFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 132 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLAQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 133 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWVLSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 134 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLVAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 135 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNPYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 136 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQPYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 137 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKATLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 138 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQLNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 139 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNSEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 140 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELLLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 141 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDPMNREKKNKIPSMQVGFIDAICLQLYEALTHVSEDCFPLLDGCRKNRQKWQALAEQQ

SEQ ID NO: 142 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSTQVGFIDAICLQLYEALTHVSEDCFPLLDGCRKNRQKWQALAEQQ

SEQ ID NO: 143 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCSPLLDGCRKNRQKWQALAEQQ

SEQ ID NO: 144 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRGGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 145 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggggcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 146 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggggaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 147 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRAGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 148 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggcgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 149 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggcaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 150 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRVGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 151 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggtgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 152 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggtaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 153 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRIGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 154 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggattggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 155 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRPGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 156 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggccgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 157 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggccaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 158 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRFGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 159 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtttggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 160 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRWGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 161 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtggggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 162 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRYGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 163 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtatggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 164 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 165 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRHGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 166 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcatggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 167 - DNA, 978 bp, Artificial Sequence; identical to SEQ ID NO: 166
  source: /note="Description of Artificial Sequence: Synthetic Destabilizing Domain (DD)"

SEQ ID NO: 168 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRSGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 169 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggagcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 170 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtcaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 171 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRTGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 172 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggaccggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 173 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRDGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 174 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggatggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 175 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 176 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKREGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 177 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggaaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 178 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggagggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 179 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRQGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 180 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcagggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 181 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcaaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 182 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRNGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 183 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggaacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 184 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRMGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 185 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggatgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 186 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRCGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 187 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtgcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 188 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRKGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 189 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggaaaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 190 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSADLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 191 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagcgccgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 192 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACALSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 193 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgccctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 194 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHHGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 195 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccatggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 196 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIHRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 197 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacatcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 198 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAEPVATEFFDQGDRERKELNIEPTDLMNREKKNKIPSMQVGFIDAICLQLYEALTHVSEDCFPLLDGCRKNRQKWQALAEQQ

SEQ ID NO: 199 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacctgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 200 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSEITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 201 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgaaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 202 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNLFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 203 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagtttcagtgactttgagctgtctgatttggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatctattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 204 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEILCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 205 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgatctcaaccttgtgcagaacttccagatgaaacatgagattctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 206 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKREVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 207 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctagaaacagcactgtgtacaattcggatgtttactgacctcaaccttgtgcagaacttccagatgaaacgtgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 208 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAVQQ

SEQ ID NO: 209 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagtacagcag

SEQ ID NO: 210 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVAIEFFDQGDRERKELNIEPTDLMNREKKNKIPSMQVGFIDAICLQLYEALTHVSEDCFPLLDGCRKNRQKWQALAEQQ

SEQ ID NO: 211 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgttcgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaattgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 212 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFGELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 213 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttggcgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 214 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFLELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 215 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttctggaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 216 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFMELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 217 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttatggaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 218 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFRELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 219 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttcgtgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 220 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFWELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 221 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttgggaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 222 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFKELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 223 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttaaagaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 224 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFQELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 225 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttcaggaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 226 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFEELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 227 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttgaagaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 228 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFSELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 229 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttagcgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 230 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFPELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 231 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttccggaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 232 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFVELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 233 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttgtggaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 234 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFIELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 235 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttattgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 236 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFCELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 237 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttgcgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 238 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFYELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 239 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttatgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 240 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFHELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 241 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttcatgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 242 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFNELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 243 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttaacgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 244 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFDELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 245 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttgatgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 246 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFTELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 247 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttaccgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 248 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSSMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 249 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaagcatggaacaccaccattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 250 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVTYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 251 - DNA, 978 bp, Artificial Sequence
  source: /note="Description of Artificial Sequence: Synthetic Destabilizing Domain (DD)"
gaagaaacaagagaactacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttacctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 252 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSANTKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 253 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaaatacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 254 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYWKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 255 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattattggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccacagatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 256 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFSTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 257 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttagtacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 258 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALYTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 259 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtatacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 260 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYRNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 261 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcgtaattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggggaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 262 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERNELNIEPTDLMNREKKNKIPSMQVGFIDAICLQLYEALTHVSEDCFPLLDGCRKNRQKWQALAEQQ

SEQ ID NO: 263 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaacgaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 264 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKDYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 265 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaaggattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 266 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNLEPTDLMNREKKNKIPSMQVGFIDAICLQLYEALTHVSEDCFPLLDGCRKNRQKWQALAEQQ

SEQ ID NO: 267 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacttagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 268 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYQKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 269 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcagaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 270 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMAHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 271 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggcccaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 272 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATALALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 273 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagccctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 274 - protein, 271 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 275 - DNA, 813 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 276 - protein, 294 aa, Artificial Sequence
  source: /note="Description of Artificial Sequence: Synthetic Destabilizing Domain (DD)"
SDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 277 - DNA, 882 bp, Artificial Sequence
  source: /note="Description of Artificial Sequence: Synthetic Destabilizing Domain (DD)"
agtgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 278 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRGGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 279 - DNA, 741 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggggcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 280 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRAGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 281 - DNA, 741 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcgggccggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 282 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRVGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 283 - DNA, 741 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcgggtgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 284 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRIGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 285 - DNA, 741 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggatcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 286 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRPGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 287 - DNA, 741 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggcccggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 288 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRFGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 289 - DNA, 741 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggttcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 290 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRWGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 291 - DNA, 741 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggtggggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 292 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRYGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 293 - DNA, 741 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggtacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 294 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRHGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 295 - DNA, 741 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggcacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 296 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRSGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 297 - DNA, 741 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggagcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 298 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRTGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 299 - DNA, 741 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggaccggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 300 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRDGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 301 - DNA, 741 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcgggacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 302 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKREGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 303 - DNA, 741 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcgggagggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 304 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRQGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 305 - DNA, 741 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggcagggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 306 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRNGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 307 - DNA, 741 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggaacggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 308 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRMGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 309 - DNA, 741 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggatgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 310 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRCGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 311 - DNA, 741 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggtgcggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 312 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRKGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 313 - DNA, 741 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggaagggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 314 - protein, 247 aa, Artificial Sequence
  source: /note="Description of Artificial Sequence: Synthetic Destabilizing Domain (DD)"
MKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 315 - DNA, 741 bp, Artificial Sequence
  source: /note="Description of Artificial Sequence: Synthetic Destabilizing Domain (DD)"
atgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 316 - protein, 302 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVS

SEQ ID NO: 317 - DNA, 906 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagcggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtca

SEQ ID NO: 318 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAFHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 319 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctttcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 320 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAWHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 321 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctggcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 322 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAAHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 323 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgccgctcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 324 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFAELIRKNQFNLEDPHQKELFLAMLMTACNLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 325 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaatttgctgaacttataagaaaaaatcaattcaatttggaagatcctcatcaaaaggagttgtttttggcaatgctgatgacagcttgtaatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 326 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACNLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 327 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtaatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 328 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFAELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 329 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaatttgctgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 330 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSADLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 331 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagcgccgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 332 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACALSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 333 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgccctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 334 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETAMCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGELFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 335 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcaatgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattgtttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 336 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEHKTTLKIIKQAILATDLALYIKRRGEFFELIRKNQFNLEDPHQKELFLAMLMTACDLSAITKPWPIQQRIAELVATEFVDQGDRERKELNIEPTDLMNREKKNKIPSMQVGFIDAICLQLYEALTHVSEDCFPLLDGCRKNRQKWQALAEQQ

SEQ ID NO: 337 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaacataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaatttgttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 338 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKYYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKKIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 339 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagtattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaaaaatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 340 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQFLSGLSIEEYKTTLKIIKQAILATDLALYIKRRGEFFELIRKNQFNLEDPHQKELFLAMLMTACDLSAITKPWPIQQRIAELVATEFFDQGDRERKGLNIEPTDLMNREKKNKIPSMQVGFIDAICLQLYEALTHVSEDCFPLLDGCRKNRQKWQALAEQQ

SEQ ID NO: 341 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagtttctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgttcttggcaatgctgatgacagcttgtgatctttctgcaattacaaaaccctggcctattcaacaacggatagcagaacttgtagcaactgaattttttgatcaaggagacagagagagaaaaggactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 342 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATGLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRNNRQKWQALAEQQ

SEQ ID NO: 343 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacaggcctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaataacaggcagaaatggcaggcccttgcagaacagcag

SEQ ID NO: 344 - protein, 326 aa, Artificial Sequence
  source: /note="Description of Artificial Sequence: Synthetic Destabilizing Domain (DD)"
EETRELQSLAAAVVPSAQTLKSTDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKDLNIEPTDLMNREKKNKIPSMQVGFIDAICLQLYEALTHVSEDCFPLLDGCRKNRQKWQALAEQQ

SEQ ID NO: 345 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaagtactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcatacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagatctcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 346 - protein, 326 aa, Artificial Sequence
  source: /note="Description of Artificial Sequence: Synthetic Destabilizing Domain (DD)"
EETRELQSLAAAVVPSAQTLKITDFSFSDFELSDMETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALSHVSEDCFPLLDGCRKNRQKWQALAEQQ

SEQ ID NO: 347 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatatggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgagccacgtgtcagaggactgtttccctttgctagatggctgcagaaagaacaggcagaaatggcaggcccttgcagaacagcag

SEQ ID NO: 348 - protein, 326 aa, Artificial Sequence
  source: /note="Description of Artificial Sequence: Synthetic Destabilizing Domain (DD)"
EETRELQSLAAAVMPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTNLMNREKKNKIPSMQVGFIDAICLQLYEALTHVSEDCFPLLDGCRKNRQKWQALAEQQ

SEQ ID NO: 349 - DNA, 978 bp, Artificial Sequence
  source: /note="Description of Artificial Sequence: Synthetic Destabilizing Domain (DD)"
gaagaaacaagagagctacagtcgttagcggctgctgtgatgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactaatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 350 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRAVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVAIEFFDQGDRERKELNIEPTDLMNREKKNKIPSMQVGFIDAICLQLYEALTHVSEDCFPLLDGCRKNRQKWQALAEQQ

SEQ ID NO: 351 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtgctgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaattgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 352 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRLAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILVTDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 353 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacttgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagttacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 354 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKYVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNLEPTDLMNREKKNKIPSMQVGFIDAICLQLYEALTHVSEDCFPLLDGCRKNRQKWQALAEQQ

SEQ ID NO: 355 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagtatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacttagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 356 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITQPWPIQQRIAELVATEFFDQGDRERKELNIEPTDLMNREKKNKIPSMQVGFIDAICLQLYEALTHVSEDCFPLLDGCRNNRQKWQALAEQQ

SEQ ID NO: 357 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacacaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaataacaggcagaaatggcaggcccttgcagaacagcag

SEQ ID NO: 358 - protein, 326 aa, Artificial Sequence
  source: /note="Description of Artificial Sequence: Synthetic Destabilizing Domain (DD)"
EETRELQSLAAAVMPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGIIDAICLQLYEALTHVSEDCFPLLDGCRKNRQKWQALAEQQ

SEQ ID NO: 359 - DNA, 978 bp, Artificial Sequence
  source: /note="Description of Artificial Sequence: Synthetic Destabilizing Domain (DD)"
gaagaaacaagagagctacagtcgttagcggctgctgtgatgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggatcatagatgccatctgcttgcaactgtatgaggccctgacccacgtgtcagaggactgtttccctttgctagatggctgcagaaagaacaggcagaaatggcaggcccttgcagaacagcag

SEQ ID NO: 360 - protein, 326 aa, Artificial Sequence
  source: /note="Description of Artificial Sequence: Synthetic Destabilizing Domain (DD)"
EETRELQSLAAAVVPFAQTRKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 361 - DNA, 978 bp, Artificial Sequence
  source: /note="Description of Artificial Sequence: Synthetic Destabilizing Domain (DD)"
gaagaaacaagagagctacagtcgttagcggctgctgtggtgccatttgcccagacccgtaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 362 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATGLALYIKRRGEFFELIRKNQFNLEDPHQKELFLAMLMTACGLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 363 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacaggcctagcactgtacattaagaggcgaggagaattttttgaacttataagaaaaaatcaattcaatttggaagatcctcatcaaaaggagttgtttttggcaatgctgatgacagcttgtggcctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 364 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALLIKRRGEFFELIRKNQFNLEDPHQKELFLAMLMTACNLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 365 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgctcattaagaggcgaggagaattttttgaacttataagaaaaaatcaattcaatttggaagatcctcatcaaaaggagttgtttttggcaatgctgatgacagcttgtaatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 366 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMAHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 367 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggcccaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 368 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATALALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 369 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagccctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 370 - protein, 326 aa, Artificial Sequence
  source: /note="Description of Artificial Sequence: Synthetic Destabilizing Domain (DD)"
EETRELQSLAAAVVPSAQTLKITDFSFGDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLAPYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCTKNRQKWQALAEQQ

SEQ ID NO: 371 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcggtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcaccgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcacaaagaacaggcagaaatggcaggcccttgcagaacagcag

SEQ ID NO: 372 - protein, 326 aa, Artificial Sequence
  source: /note="Description of Artificial Sequence: Synthetic Destabilizing Domain (DD)"
EETRELQSLAAAVVPSAQTLKITDFSFSDFELSDLESALCTIRMFTDLNLMQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILASDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 373 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaatcagcactgtgtacaattcggatgtttactgacctcaaccttatgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgtctgatgattcttaatagtccaggcaatcagattctcagtggcctctccattgaagaatataagaccacgttgaaaataatcaagcaagctattttagcttcagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 374 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILVTDLALYIKRRGEFFELIRKNQFNLEDPHQKELLLAMLITACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 375 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagttacagacctagcactgtacattaagaggcgaggagaattttttgaacttataagaaaaaatcaattcaatttggaagatcctcatcaaaaggagttgttattggcaatgctgatcacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 376 - protein, 326 aa, Artificial Sequence
  source: /note="Description of Artificial Sequence: Synthetic Destabilizing Domain (DD)"
EETRELQLLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEVYKTTLKIIKQAILATDLALYIKRRGEFFELIRKNQFNLEDPHQKELFLAMLMTACDLSAITKPCPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 377 - DNA, 978 bp, Artificial Sequence
  source: /note="Description of Artificial Sequence: Synthetic Destabilizing Domain (DD)"
gaagaaacaagagagctacagttgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcactgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagtatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctgtcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 378 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTMLKIIKQAILATDLALYIKRRGEFFELIRKNQFNLEDPHQKELFLAILMTACDLSAITKPWPIQQRIAELVATEFFDQGDRERKELNIEPTDLMNREKKNKIPSMQVGFIDAICLQLYEALTHVSEDCFPLLDGCRKNRQKWQALAERQ

SEQ ID NO: 379 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccatgttgaaaataatcaagcaagctattttagctacagacctagcactgtacattaagaggcgaggagaattttttgaacttataagaaaaaatcaattcaatttggaagatcctcatcaaaaggagttgtttttggcaatactgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacggcag

SEQ ID NO: 380 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYLNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATYLALYIKRRGEFFELIRKNQFNLEDPHQKELYLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 381 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcttaattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacatacctagcactgtacattaagaggcgaggagaattttttgaacttataagaaaaaatcaattcaatttggaagatcctcatcaaaaggagttgtatttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 382 - protein, 326 aa, Artificial Sequence
  source: /note="Description of Artificial Sequence: Synthetic Destabilizing Domain (DD)"
EETRELQSLAAAVVPSAQTRKITDFSFSDFELSDLETALCTIRMFTDLNLVQNFEMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLIILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 383 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccgtaaaattactgactttagcttcagtgactttgagctgtctgatctggaaacagcactgtgtacaattcggatgtttactgacctcaaccttgtgcagaacttcgagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatcattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 384 - protein, 326 aa, Artificial Sequence
  source: /note="Description of Artificial Sequence: Synthetic Destabilizing Domain (DD)"
EETRELQSLAAAVVPSAQTRKITDFSFSDFELSDLETALCTIRMFTDLNLVQNFEMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDTICLQLYEALTHVSEDCFPLLDGCRKNRQKWQALAEQQ

SEQ ID NO: 385 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccgtaaaattactgactttagcttcagtgactttgagctgtctgatctggaaacagcactgtgtacaattcggatgtttactgacctcaaccttgtgcagaacttcgagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagataccatctgcttgcaactgtatgaggccctgacccacgtgtcagaggactgtttccctttgctagatggctgcagaaagaacaggcagaaatggcaggcccttgcagaacagcag

SEQ ID NO: 386 - protein, 326 aa, Artificial Sequence
  source: /note="Description of Artificial Sequence: Synthetic Destabilizing Domain (DD)"
EETRELQSLAAAVVPSAQTLKITDFSLSDFELSDLETALCTIRMFTDLNLVQNFQMKHEVLCRWILSVKKNYRKNVAYHNWRHAFNTAQCMFAALKAGKIQNKLTDLEILALLIAALSHDLDHRAVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVAIEFFDQGDRERKELNIEPTDLMNREKKNKIPSMQVGFIDAICLQLYEALTHVSEDCFPLLDGCRKNRQKWQALAEQQ

SEQ ID NO: 387 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttaagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtgctgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaattgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 388 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNRRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILARDLALYIKRRGEFFELIRKNQFNLEDPHQKELFLAMLMTTCDLSAITKPWPIQQRIAELVATEFFDQGDRERKELNIEPTDLMNRGKKNKIPSMQVGFIDAICLQLYEALTHVSEDCFPLLDGCRKNRQKWQALAEQQ

SEQ ID NO: 389 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataatcggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctagagacctagcactgtacattaagaggcgaggagaattttttgaacttataagaaaaaatcaattcaatttggaagatcctcatcaaaaggagttgtttttggcaatgctgatgacaacttgtgatctttctgcaattacaaaaccctggcctattcaacaacggatagcagaacttgtagcaactgaattttttgatcaaggagacagagagagaaaagaactcaacatagaacccactgatctaatgaacagggggaagaaaaacaaaatcccaagtatgcaagttgggttcatagatgccatctgcctgcaactgtatgaggccctgacccacgtgtcagaggactgtttccctttgctagatggctgcagaaagaacaggcagaaatggcaggcccttgcagaacagcag

SEQ ID NO: 390 - protein, 326 aa, Artificial Sequence
  source: /note="Description of Artificial Sequence: Synthetic Destabilizing Domain (DD)"
EETRELQSLAAAVVPSAQTRKITDFSFSDFELSDLETALCTIRMFTDLNLVPNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYNTTLKIIKQAILATDLALYIERRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 391 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccgtaaaattactgactttagcttcagtgactttgagctgtctgatctggaaacagcactgtgtacaattcggatgtttactgacctcaaccttgtgccgaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagcgaacatccacttgcccagctttactgccattcaatcatggaacaccatcattttgaccagtgcctgatgattcttaatagtccaggcaatcagattctcagtggcctctccattgaagaatataataccacgttgaaaataatcaagcaagctattttagctacagacctagcactgtacattgagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 392 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVLNFQMKHEVLCRWILSVKKNYRKNVAYHNWRHAFNTAQCMFAALKAGKIQNKLTDLEILALLIAALSHDLDHRGVNNYYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTTCDLSAITKPWPIQQRIAELVATEFFDQGDRERKELNIEPTDLMNRGKKNKIPSMQVGFIDAICLQLYEALTHVSEDCFPLLDGCRKNRQKWQALAEQQ

SEQ ID NO: 393 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgctgaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactattacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacaacttgtgatctttctgcaattacaaaaccctggcctattcaacaacggatagcagaacttgtagcaactgaattttttgatcaaggagacagagagagaaaagaactcaacatagaacccactgatctaatgaacagggggaagaaaaacaaaatcccaagtatgcaagttgggttcatagatgccatctgcctgcaactgtatgaggccctgacccacgtgtcagaggactgtttccctttgctagatggctgcagaaagaacaggcagaaatggcaggcccttgcagaacagcag

SEQ ID NO: 394 - protein, 326 aa, Artificial Sequence
  source: /note="Description of Artificial Sequence: Synthetic Destabilizing Domain (DD)"
EETRELQSLAAAVVPSAQTLKITDFSFSDFELSDLEIALCTIRMFTDLNLVQNFQMKHEVLCRWILSVKRNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSNEEYKTTLKIIKQAILATDLALYIKRRGEFFELIRKNQFNLEDPHQKELFLAMLMTACDLSAITKPWPIQQRIAELVATEFFDQGDRERRELNIEPTDLMNREKKNKIPSMQVGFIDAICLQLYEALTHVSEDCFPLLDGCRKNRQKWQALAEQQ

SEQ ID NO: 395 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaatagcactgtgtacaattcggatgtttactgacctcaaccttgtgcagaacttccagatgaaacatgaggttctttgcagatggattttaagtgttaagaggaattatcggaagaatgttgcctatcataattggagacatgcctttaatacagctcagtgcatgtttgctgctctaaaagcaggcaaaattcagaacaaactgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccaatgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaagagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 396 - protein, 326 aa, Artificial Sequence
  source: /note="Description of Artificial Sequence: Synthetic Destabilizing Domain (DD)"
EETRELQSLAAAVVPSAQTLKITDFSFSDIELSDLETALCTIRMFTDLNLVQNFQMKHEVLCRWILSVKKNYRKNVAYHNWRHAFNTAQCMFAALKAGKIQNKLTDLEILALLIAALSHDLDHRGVNYSYIQRSEHPLAQLYCHSIMEHHLFDQCLMIPNSPGNQILSGLSIEEYKTTLKIIKQAILATDLALYIKRRGEFIELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 397 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgacattgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaattactcttacatacagcgaagtgaacatccacttgcccagctttactgccattcaatcatggaacaccatctttttgaccagtgcctgatgattcctaatagtccaggcaatcagattctcagtggcctctccattgaagaatataagaccacgttgaaaataatcaagcaagctattttagctacagacctagcactgtacattaagaggcgaggagaatttattgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 398 - protein, 326 aa, Artificial Sequence
  source: /note="Description of Artificial Sequence: Synthetic Destabilizing Domain (DD)"
EETRELQSLAAAVVSSAQTLKITDFSFSDIELSDLETALCTIRMFTDLNLVQNFQMKHEVLCRWILSVKKNYRKNVAYHNWRHAFNTAQCMFAALKAGKIQNKLTDLEILALLIAALSHDLDHHGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRITELVATEFFDQGDRERKELNIEPTDLMNREKKNKIPSMQVGFIDAICLQLYEALTHVSEDCFPLLDGCGKNRQKWQALAEQQ

SEQ ID NO: 399 - DNA, 978 bp, Artificial Sequence
  source: /note="Description of Artificial Sequence: Synthetic Destabilizing Domain (DD)"
gaagaaacaagagagctacagtcgttagcggctgctgtggtgtcatctgcccagacccttaaaattactgactttagcttcagtgacattgagctgtctgatctggagacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccatggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggataacagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcggaaagaacaggcagaaatggcaggcccttgcagaacagcag

SEQ ID NO: 400 - DNA, 2628 bp, Homo sapiens
atggagcgggccggccccagcttcgggcagcagcgacagcagcagcagccccagcagcagaagcagcagcagagggatcaggactcggtcgaagcatggctggacgatcactgggactttaccttctcatactttgttagaaaagccaccagagaaatggtcaatgcatggtttgctgagagagttcacaccatccctgtgtgcaaggaaggtatcagaggccacaccgaatcttgctcttgtcccttgcagcagagtcctcgtgcagataacagtgcccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaactga

SEQ ID NO: 401 - DNA, 6836 bp, Homo sapiens
tggttctgagtcgccgacctcacctcacctcacctgcgcgcgttgttgcccctacggagcctcctggagtccaggatcggcggagttcgaaaacgaacttcccacgtttgctatgttgccctttggagacaaaacaagagaaatggtcaatgcatggtttgctgagagagttcacaccatccctgtgtgcaaggaaggtatcagaggccacaccgaatcttgctcttgtcccttgcagcagagtcctcgtgcagataacagtgcccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaactgagtggcctatttcatgcagagttgaagtttacagagatggtgtgttctgcaatatgcctagtttcttacacactgtctgtatagtgtctgtatttggtatatactttgccactgctgtatttttatttttgcacaacttttgagagtatagcatgaatgtttttagaggactattacatattttttgtatatttgttttatgctactgaactgaaaggatcaacaacatccactgttagcacattgataaaagcattgtttgtgatatttcgtgtactgcaaagtgtatgcagtattcttgcactgaggtttttttgcttggggattattttaaataattggtttttgtgttttctgaattaccattttttcaagaatgtttggaatctttcctttttcaaaagtaggttaggagcaaattatcatacattctgtgacatttaaagcctttataggatagtgaaaaatgctggctgagtggattttaagagaaataattgtatttgttaacagtgtctttttttaaaaagttaaggcactctgaaacaaatggaaagtcctatgaaactgtattgtaaagaaaacattatttaattgatatgctgttttgtgagagaacaggcaagacagaactttgtcacttcagtgcagtacatttttctgaaagctacccataaaatcactttcatctcacctacctgatgcaaagcaggtgaaaccttaggagatgatccagtcactgacttgattgagggataagtgtgatttagaaatggaatggccttggatgtctatcagtgaagaaaaatgttctgttagaagatctctctaagagtttttttccttctgagcttccttttcaaaataaaagtgacaattgtagcattgacttgaagtgagacatggttatagataagagagtacaaaatgactctttttcctgtcaattgaaatttaaagaaaagttttaattatataaatagcaaagggctattgccaatactagggtcaaaaatgaatttgagggaacagtgggtaagaaactttatgcctgaataacatttagcagtattgtgattgaaaaattgccatattttgatgtataggacaagtcaactgagatccagagaatcctggatgtgaatgctaaacactggcccttaactcacattcaatgtattttcttcccataacatttagtatagttaatattttcttagaatttgagcccatttaagtggattaatattctacatgtgtgcccctaaagacacatttactcaatattggagaagtagataatgaattaagcaactggtctaggaaaggaaaatttgtttcaaatatgcaggaatgtttggatttggggagagtagaaggagagatttgcttgatttgttaacttctacctccaacccacaaaaaagatatttgatctgagtttctatcactaatttggatagaaaatttctaagggacatggtaatccagcattctcaaggacctttcgccaaaatgtgttttccatctatgtcccgattcccctaaattttgcctaaaattcagtatgttccttaagtttttaaaattctgagtgtgtacaaatatcttgacataatgcagttttatttttatcattctggtaaaaaaacaaaaaatagaagcaaaacacattgtattgccattattttgtatttggtaaaggttaatctaggaagttaccaactgtttaatgctatatgtattgtatacttgtattttcaggatattttattttttttgccatacagataaaatttgtaaggttgcccctttgtggcactggtgtgtaaaatacacagactatcactaaaataatagttatatatacatacaggtgtatacttatgcatgcatacataaatccttagtatagaaaaattgcataaagaatagcaatctttaataaacctttttattacattgtgatttagcagttatgctaaaatatgtacttatgctttagtagtttgtttggtcccctctagtatgtgtcactgagaaattttttaaagacatggtagatcgtgtttagaggctttgtatgtgtgtcattttaataagcaagaagatatatttagattagaaatggtttggtctgcctttgaatattgtttattttactttactagttgagacattaaaggaagctgggcaatgcctattttatttctttgttggatattttagttcatacaaagcagagtacttctttagggctggttaattggttcaaataatttttaatttcctttctagtatcttctcaagttggaaaaatatacatacagtcctccttcaccttactctgtatttatattacccataactagcaagaagttcttgttctagattttttgtttgtttagttataacagagtaacataccatttaattacaatttttagccagaaaagtccccactattttactaacttgttaaaagatatctatataattgcctggccttatatttttcagtagattagaccgtgccaatcacaatcctgggtggatttgtgtaagtcacttaacctctgtgtgcctaaacaagttgtgcttttttaaaaggagttatgtttgggcaaagcctttgtcttcaagcagaatgtcacagaaggcagctactttataagccccaatgggccatggagaccactgtcagaaatgggatattagtctagagagaaggtgatctattcccacatgtcatttctaatgttgagtttccatgactgaacaaagagaatatatttattcagcttcacttgcagatcactagtgaatgtgagatttagagctcattgagtatattgcttcaaggtacaaacccaggatgatgatgttgtcaccactgtctcttaattttgaataatagtttcctttaataggagtattagagataagaaagtatatgaaaatatactggaaatattggattcttggagaaaactgttcagtcacagatatattcttgcctagcagtgaagtgcctttattttcagcatagcaaataaatattagacctgttccaatttgatctacaatttttttctgtgtttttcaccagattgtactcctaaaacttaacaggccatcacaagcaattgtcttttgtttacaagattgatttaatatgagaggatacaaaatgtcatcgttatcctctcttatgaacaactgtagtcaaaataaggtggcacaatttaattgttttgtatcagaaatacactgacccaccttttattgagtcctgccacatgttaggtaccgtgctctgctgtggagacagagcagtgaccccaaggagctcacggtccctgaaggaggtgctagagaagagacttagcttctgatactgccaatttaatgtgagaacatggggtatactgcatcatttccattttcatcaataacatatgttttatgcaccttctttacctgaaacttactaagaatctaccagtaaacaaacatcctgtctttttgcaagtatgaatcacttaacctgctgatagttgaagaacactttaggagttttgtattcttgtatatagtttattttttccatgtgctagccaggtaaagattacacagttcttctggactgttaaattgtgcatggttttggaccccttctgctctactacagagagtgaagaagaaagtattaaagctcactttaccattccatatacttactaaaagcctgtgtaaacatgtcttaatgaatgttgttgaaagcaatgtaaatagttgaaaatataaatttatattacagtttaagaaaaccttatgaggcatcactagccactgttaatatctatttgtattcttataccttttcaatatatttgaacaaatatagtttctggcactatttttatactaggaaaaggagttactatgtatattatgcttagcttttaaggcattttaaataaccatgaatgttgatttcattactttcctttcctccatcacgagagtcatttcagatgactctttcatgacaaaatcactttaaaggaacacttacctccgattcctgtataaagtcatgagatggtcaaggtggttttccattgtgcaaattcttcacctgtcagtggtttcctcattttgccatgctttgtaaaaataaaaagaatgatcaagtaggtatgaaaaaaaaaaaaaaaaaa

SEQ ID NO: 402 - DNA, 2499 bp, Homo sapiens
atgttgccctttggagacaaaacaagagaaatggtcaatgcatggtttgctgagagagttcacaccatccctgtgtgcaaggaaggtatcagaggccacaccgaatcttgctcttgtcccttgcagcagagtcctcgtgcagataacagtgcccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaac

SEQ ID NO: 403 - DNA, 6788 bp, Homo sapiens
cctcgccctggccctggctgggcggggaagctggggtgagggacgagtccacgggacagcccaaaggcaacatgacggaaccttgccaaaagaaatggtcaatgcatggtttgctgagagagttcacaccatccctgtgtgcaaggaaggtatcagaggccacaccgaatcttgctcttgtcccttgcagcagagtcctcgtgcagataacagtgcccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaactgagtggcctatttcatgcagagttgaagtttacagagatggtgtgttctgcaatatgcctagtttcttacacactgtctgtatagtgtctgtatttggtatatactttgccactgctgtatttttatttttgcacaacttttgagagtatagcatgaatgtttttagaggactattacatattttttgtatatttgttttatgctactgaactgaaaggatcaacaacatccactgttagcacattgataaaagcattgtttgtgatatttcgtgtactgcaaagtgtatgcagtattcttgcactgaggtttttttgcttggggattattttaaataattggtttttgtgttttctgaattaccattttttcaagaatgtttggaatctttcctttttcaaaagtaggttaggagcaaattatcatacattctgtgacatttaaagcctttataggatagtgaaaaatgctggctgagtggattttaagagaaataattgtatttgttaacagtgtctttttttaaaaagttaaggcactctgaaacaaatggaaagtcctatgaaactgtattgtaaagaaaacattatttaattgatatgctgttttgtgagagaacaggcaagacagaactttgtcacttcagtgcagtacatttttctgaaagctacccataaaatcactttcatctcacctacctgatgcaaagcaggtgaaaccttaggagatgatccagtcactgacttgattgagggataagtgtgatttagaaatggaatggccttggatgtctatcagtgaagaaaaatgttctgttagaagatctctctaagagtttttttccttctgagcttccttttcaaaataaaagtgacaattgtagcattgacttgaagtgagacatggttatagataagagagtacaaaatgactctttttcctgtcaattgaaatttaaagaaaagttttaattatataaatagcaaagggctattgccaatactagggtcaaaaatgaatttgagggaacagtgggtaagaaactttatgcctgaataacatttagcagtattgtgattgaaaaattgccatattttgatgtataggacaagtcaactgagatccagagaatcctggatgtgaatgctaaacactggcccttaactcacattcaatgtattttcttcccataacatttagtatagttaatattttcttagaatttgagcccatttaagtggattaatattctacatgtgtgcccctaaagacacatttactcaatattggagaagtagataatgaattaagcaactggtctaggaaaggaaaatttgtttcaaatatgcaggaatgtttggatttggggagagtagaaggagagatttgcttgatttgttaacttctacctccaacccacaaaaaagatatttgatctgagtttctatcactaatttggatagaaaatttctaagggacatggtaatccagcattctcaaggacctttcgccaaaatgtgttttccatctatgtcccgattcccctaaattttgcctaaaattcagtatgttccttaagtttttaaaattctgagtgtgtacaaatatcttgacataatgcagttttatttttatcattctggtaaaaaaacaaaaaatagaagcaaaacacattgtattgccattattttgtatttggtaaaggttaatctaggaagttaccaactgtttaatgctatatgtattgtatacttgtattttcaggatattttattttttttgccatacagataaaatttgtaaggttgcccctttgtggcactggtgtgtaaaatacacagactatcactaaaataatagttatatatacatacaggtgtatacttatgcatgcatacataaatccttagtatagaaaaattgcataaagaatagcaatctttaataaacctttttattacattgtgatttagcagttatgctaaaatatgtacttatgctttagtagtttgtttggtcccctctagtatgtgtcactgagaaattttttaaagacatggtagatcgtgtttagaggctttgtatgtgtgtcattttaataagcaagaagatatatttagattagaaatggtttggtctgcctttgaatattgtttattttactttactagttgagacattaaaggaagctgggcaatgcctattttatttctttgttggatattttagttcatacaaagcagagtacttctttagggctggttaattggttcaaataatttttaatttcctttctagtatcttctcaagttggaaaaatatacatacagtcctccttcaccttactctgtatttatattacccataactagcaagaagttcttgttctagattttttgtttgtttagttataacagagtaacataccatttaattacaatttttagccagaaaagtccccactattttactaacttgttaaaagatatctatataattgcctggccttatatttttcagtagattagaccgtgccaatcacaatcctgggtggatttgtgtaagtcacttaacctctgtgtgcctaaacaagttgtgcttttttaaaaggagttatgtttgggcaaagcctttgtcttcaagcagaatgtcacagaaggcagctactttataagccccaatgggccatggagaccactgtcagaaatgggatattagtctagagagaaggtgatctattcccacatgtcatttctaatgttgagtttccatgactgaacaaagagaatatatttattcagcttcacttgcagatcactagtgaatgtgagatttagagctcattgagtatattgcttcaaggtacaaacccaggatgatgatgttgtcaccactgtctcttaattttgaataatagtttcctttaataggagtattagagataagaaagtatatgaaaatatactggaaatattggattcttggagaaaactgttcagtcacagatatattcttgcctagcagtgaagtgcctttattttcagcatagcaaataaatattagacctgttccaatttgatctacaatttttttctgtgtttttcaccagattgtactcctaaaacttaacaggccatcacaagcaattgtcttttgtttacaagattgatttaatatgagaggatacaaaatgtcatcgttatcctctcttatgaacaactgtagtcaaaataaggtggcacaatttaattgttttgtatcagaaatacactgacccaccttttattgagtcctgccacatgttaggtaccgtgctctgctgtggagacagagcagtgaccccaaggagctcacggtccctgaaggaggtgctagagaagagacttagcttctgatactgccaatttaatgtgagaacatggggtatactgcatcatttccattttcatcaataacatatgttttatgcaccttctttacctgaaacttactaagaatctaccagtaaacaaacatcctgtctttttgcaagtatgaatcacttaacctgctgatagttgaagaacactttaggagttttgtattcttgtatatagtttattttttccatgtgctagccaggtaaagattacacagttcttctggactgttaaattgtgcatggttttggaccccttctgctctactacagagagtgaagaagaaagtattaaagctcactttaccattccatatacttactaaaagcctgtgtaaacatgtcttaatgaatgttgttgaaagcaatgtaaatagttgaaaatataaatttatattacagtttaagaaaaccttatgaggcatcactagccactgttaatatctatttgtattcttataccttttcaatatatttgaacaaatatagtttctggcactatttttatactaggaaaaggagttactatgtatattatgcttagcttttaaggcattttaaataaccatgaatgttgatttcattactttcctttcctccatcacgagagtcatttcagatgactctttcatgacaaaatcactttaaaggaacacttacctccgattcctgtataaagtcatgagatggtcaaggtggttttccattgtgcaaattcttcacctgtcagtggtttcctcattttgccatgctttgtaaaaataaaaagaatgatcaagtaggtatgaaaaaaaaaaaaaaaaaa

SEQ ID NO: 404 - DNA, 2469 bp, Homo sapiens
atggtcaatgcatggtttgctgagagagttcacaccatccctgtgtgcaaggaaggtatcagaggccacaccgaatcttgctcttgtcccttgcagcagagtcctcgtgcagataacagtgcccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaac

SEQ ID NO: 405 - DNA, 477 bp, Homo sapiens
atgatctctctgattgcggcgctggcagttgaccgcgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgtttacgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgt

SEQ ID NO: 406 - DNA, 978 bp, Homo sapiens
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 407 - DNA, 561 bp, Homo sapiens
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 408 - DNA, 406 bp, Homo sapiens
gggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaa

SEQ ID NO: 409 - DNA, 389 bp, Homo sapiens
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaccagaattagcaaataaagtagacatggtctggatagttggtggcagttctgtttataagatacccaggtgttctctctga

SEQ ID NO: 410 - DNA, 554 bp, Homo sapiens
atgtttcttttgctaaactgcatcgtcgctgtgtcccaaaacatgggcatcggcaagaacggggacctgcccaggccgccgctcaggaatgaattcaggtatttccagagaatgaccacaacttcttcagtagagggtaaacagaatctggtgattatgggtaggaagacctggttctccattcctgagaagaatcgacctttaaaggatagaattaatttagttctcagcagagaactcaaggaacctccacaaggagctcattttcttgccagaagtttggatgatgccttaaaacttactgaacgaccagaattagcaaataaagtagacatgatttggatagttggtggcagttctgtttataaggaagccatgaatcacctaggccatcttaaactatttgtgacaaggatcatgcaggactttgaaagtgacacgtttttttcagaaattgacttggagaaatataaacttctgcctgaatacccaggtgttctctctgatgtccaggaggggaaacacatcaagtacaaatttgaagtatgtgagaa

SEQ ID NO: 411 - DNA, 735 bp, Homo sapiens
tcgttggcactttccctgactgccgaccagatggtgtccgcccttctggacgccgagcctccaattctgtactcggagtacgatccgactcgcccgttctccgaagccagcatgatgggcctgttgactaacctggcggaccgcgagttggtgcacatgattaactgggctaagcgggtgccgggcttcgtggacctgactctgcacgaccaagtgcacctcctggaatgcgcctggctggaaatcctcatgatcggcctcgtgtggagatccatggagcatcccggaaagctcctgtttgcacccaacctcctgcttgatcgcaaccagggaaaatgcgtggaagggatggtcgagattttcgacatgctgctcgccacctcttcccggttccggatgatgaatctgcagggagaagagttcgtgtgtctgaagtcaatcatcctgctgaactccggggtctataccttcctgagctcgaccctcaagtcactggaggaaaaagaccacatccatcgcgtgctcgataagatcaccgacacccttatccatctcatggcgaaggctggactgaccctgcaacagcagcaccagaggctggcccagttgctgctgattctgagccacatccggcacatgtcgaacaaggggatggaacacctgtacagcatgaagtgcaagaacgtcgtgcctctgtacgatctgctcctggaaatgctggacgcgcacagactc

SEQ ID NO: 412 - protein, 21 aa, Homo sapiens
MALPVTALLLPLALLLHAARP

SEQ ID NO: 413 - DNA, 63 bp, Homo sapiens
atggccttaccagtgaccgccttgctcctgccgctggccttgctgctccacgccgccaggccg

SEQ ID NO: 414 - DNA, 63 bp, Homo sapiens
atggcactgcctgtgaccgccctgctgctgccactggccctgctgctgcacgcagccaggccc

SEQ ID NO: 415 - protein, 22 aa, Homo sapiens
MCHQQLVISWFSLVFLASPLVA

SEQ ID NO: 416 - DNA, 66 bp, Homo sapiens
atgtgccaccaacagctcgtgatcagctggttctccctggtgttcctggctagccccctggtggcc

SEQ ID NO: 417 - protein, 19 aa, Artificial Sequence
  source: /note="Description of Artificial Sequence: Synthetic Cleavage site sequence"
ATNFSLLKQAGDVEENPGP

SEQ ID NO: 418 - DNA, 57 bp, Artificial Sequence
  source: /note="Description of Artificial Sequence: Synthetic Cleavage site sequence"
gctactaacttcagcctgctgaagcaggctggagacgtggaggagaaccctggacct

SEQ ID NO: 419 - protein, 4 aa, Artificial Sequence
  source: /note="Description of Artificial Sequence: Synthetic Linker"
GGGG

SEQ ID NO: 420 - protein, 8 aa, Artificial Sequence
  source: /note="Description of Artificial Sequence: Synthetic Linker"
GGGGGGGG

SEQ ID NO: 421 - protein, 15 aa, Artificial Sequence
  source: /note="Description of Artificial Sequence: Synthetic Linker"
GGGGSGGGGSGGGGS

SEQ ID NO: 422 - DNA, 45 bp, Artificial Sequence
  source: /note="Description of Artificial Sequence: Synthetic Linker"
ggaggaggaggcagcggaggaggaggttctggaggaggcggcagc

SEQ ID NO: 423 - protein, 5 aa, Artificial Sequence
  source: /note="Description of Artificial Sequence: Synthetic Linker"
GGGGG

SEQ ID NO: 424 - protein, 8 aa, Artificial Sequence
  source: /note="Description of Artificial Sequence: Synthetic Linker"
GSGSGSGS

SEQ ID NO: 425 - protein, 242 aa, Artificial Sequence
  source: /note="Description of Artificial Sequence: Synthetic scFv sequence"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 426 - DNA, 726 bp, Artificial Sequence
  source: /note="Description of Artificial Sequence: Synthetic scFv sequence"
gacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctca

SEQ ID NO: 427 - protein, 69 aa, Homo sapiens
TTTPAPRPPTPAPTIASQPLSLRPEACRPAAGGAVHTRGLDFACDIYIWAPLAGTCGVLLLSLVITLYC

SEQ ID NO: 428 - DNA, 207 bp, Homo sapiens
accacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgc

SEQ ID NO: 429 - DNA, 207 bp, Homo sapiens
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgc

SEQ ID NO: 430 - protein, 112 aa, Homo sapiens
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 431 - DNA, 336 bp, Artificial Sequence
  source: /note="Description of Artificial Sequence: Synthetic polynucleotide"
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 432 - protein, 42 aa, Homo sapiens
KRGRKKLLYIFKQPFMRPVQTTQEEDGCSCRFPEEEEGGCEL

SEQ ID NO: 433 - DNA, 126 bp, Artificial Sequence
  source: /note="Description of Artificial Sequence: Synthetic polynucleotide"
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 434 - protein, 328 aa, Homo sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 435 - DNA, 2761 bp, Homo sapiens
gggcatacagttgttccatcccgacatgaactcagcctcccgtctgaccgccccttggccttccttcttcctcgatctgtggaacccagggaatctgcctagtgctgtctccaagcaccttggccatgatgtaaacccagagaaattagcatctccatctccttccttattccccacccaaaagtcatttcctcttagttcattacctgggattttgatgtctatgttccctcctcgttattgatacacacacagagagagacaaacaaaaaaggaacttcttgaaattcccccagaaggttttgagagttgttttcaatgttgcaacaagtcagtttctagtttaagtttccatcagaaaggagtagagtatataagttccagtaccagcaacagcagcagaagaaacaacatctgtttcagggccattggactctccgtcctgcccagagcaagatgtgtcaccagcagttggtcatctcttggttttccctggtttttctggcatctcccctcgtggccatatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagttaggttctgatccaggatgaaaatttggaggaaaagtggaagatattaagcaaaatgtttaaagacacaacggaatagacccaaaaagataatttctatctgatttgctttaaaacgtttttttaggatcacaatgatatctttgctgtatttgtatagttagatgctaaatgctcattgaaacaatcagctaatttatgtatagattttccagctctcaagttgccatgggccttcatgctatttaaatatttaagtaatttatgtatttattagtatattactgttatttaacgtttgtctgccaggatgtatggaatgtttcatactcttatgacctgatccatcaggatcagtccctattatgcaaaatgtgaatttaattttatttgtactgacaacttttcaagcaaggctgcaagtacatcagttttatgacaatcaggaagaatgcagtgttctgataccagtgccatcatacacttgtgatggatgggaacgcaagagatacttacatggaaacctgacaatgcaaacctgttgagaagatccaggagaacaagatgctagttcccatgtctgtgaagacttcctggagatggtgttgataaagcaatttagggccacttacacttctaagcaagtttaatctttggatgcctgaattttaaaagggctagaaaaaaatgattgaccagcctgggaaacataacaagaccccgtctctacaaaaaaaatttaaaattagccaggcgtggtggctcatgcttgtggtcccagctgttcaggaggatgaggcaggaggatctcttgagcccaggaggtcaaggctatggtgagccgtgattgtgccactgcataccagcctaggtgacagaatgagaccctgtctcaaaaaaaaaaatgattgaaattaaaattcagctttagcttccatggcagtcctcacccccacctctctaaaagacacaggaggatgacacagaaacaccgtaagtgtctggaaggcaaaaagatcttaagattcaagagagaggacaagtagttatggctaaggacatgaaattgtcagaatggcaggtggcttcttaacagccctgtgagaagcagacagatgcaaagaaaatctggaatccctttctcattagcatgaatgaacctgatacacaattatgaccagaaaatatggctccatgaaggtgctacttttaagtaatgtatgtgcgctctgtaaagtgattacatttgtttcctgtttgtttatttatttatttatttttgcattctgaggctgaactaataaaaactcttctttgtaatc

SEQ ID NO: 436 - protein, 306 aa, Homo sapiens
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 437 - DNA, 918 bp, Artificial Sequence
  source: /note="Description of Artificial Sequence: Synthetic construct"
atctgggagctgaagaaggacgtgtacgtggtggagctggactggtatcccgatgcccctggcgagatggtggtgctgacctgcgacacacctgaggaggatggcatcacctggacactggatcagtctagcgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtcctctaggggcagctccgacccccagggcgtgacatgcggagcagccaccctgtccgccgagagggtgcgcggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatccgggacatcatcaagcccgatccacccaagaacctgcagctgaagcctctgaagaattctagacaggtggaggtgagctgggagtacccagacacctggtccacaccccactcttatttcagcctgaccttttgcgtgcaggtgcagggcaagagcaagagggagaagaaggaccgcgtgttcaccgataagacatccgccaccgtgatctgtaggaagaacgcctccatctctgtgagggcccaggatcgctactattcctctagctggtccgagtgggcctctgtgccctgtagc

SEQ ID NO: 438 - DNA, 918 bp, Artificial Sequence
  source: /note="Description of Artificial Sequence: Synthetic construct"
atctgggagctgaagaaggacgtgtacgtggtggagctggactggtatcccgatgcccctggcgagatggtggtgctgacctgcgacacaccagaggaggatggcatcacctggacactggatcagtctagcgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtcctctaggggcagctccgacccccagggcgtgacatgcggagcagccaccctgtccgccgagagggtgcgcggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatccgggacatcatcaagcccgatccacccaagaacctgcagctgaagcctctgaagaattctagacaggtggaggtgagctgggagtacccagacacctggtccacaccccactcttatttcagcctgaccttttgcgtgcaggtgcagggcaagtccaagagggagaagaaggaccgcgtgttcaccgataagacatctgccaccgtgatctgtaggaagaacgcctccatctctgtgagggcccaggatcgctactattcctctagctggtccgagtgggcctctgtgccctgtagc

SEQ ID NO: 439 - DNA, 918 bp, Artificial Sequence
  source: /note="Description of Artificial Sequence: Synthetic construct"
atctgggagctgaagaaggacgtgtacgtggtggagctggactggtatcccgatgcccctggcgagatggtggtgctgacctgcgacacacctgaggaggatggcatcacctggacactggatcagtctagcgaggtgctgggctccggcaagaccctgacaatccaggtgaaggagttcggcgacgccggccagtacacatgtcacaagggcggcgaggtgctgtctcacagcctgctgctgctgcacaagaaggaggacggcatctggtccacagacatcctgaaggatcagaaggagccaaagaacaagaccttcctgaggtgcgaggccaagaattatagcggccgctttacctgttggtggctgaccacaatcagcaccgatctgacattttccgtgaagtcctctaggggcagctccgacccccagggcgtgacatgcggagcagccaccctgtccgccgagcgggtgagaggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatcagggacatcatcaagcccgatccacccaagaacctgcagctgaagcctctgaagaattctcgccaggtggaggtgagctgggagtacccagacacctggagcacaccccactcttatttcagcctgaccttttgcgtgcaggtgcagggcaagtctaagcgggagaagaaggacagagtgttcaccgataagacaagcgccaccgtgatctgtcggaagaacgcctccatctctgtgcgggcccaggatagatactattcctctagctggtccgagtgggcctctgtgccctgtagc

SEQ ID NO: 440 - DNA, 918 bp, Artificial Sequence
  source: /note="Description of Artificial Sequence: Synthetic construct"
atctgggagctgaagaaggacgtgtacgtggtggagctggactggtatcccgatgcccctggcgagatggtggtgctgacctgcgacacacctgaggaggatggcatcacctggacactggatcagagctccgaggtgctgggaagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgaggtgcgaggccaagaattatagcggccgctttacctgttggtggctgaccacaatcagcaccgatctgacattttccgtgaagtctagcagaggctcctctgacccccagggcgtgacatgcggagcagccaccctgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctcgccaggtggaggtgagctgggagtacccagacacctggtccacaccccactcttatttcagcctgaccttttgcgtgcaggtgcagggcaagagcaagagggagaagaaggaccgcgtgttcaccgataagacatccgccaccgtgatctgtcggaagaacgcctccatctctgtgcgggcccaggatagatactattctagctcctggtccgagtgggcctctgtgccctgtagc

SEQ ID NO: 441 - DNA, 918 bp, Artificial Sequence
  source: /note="Description of Artificial Sequence: Synthetic construct"
atctgggagctgaagaaggacgtgtacgtggtggagctggactggtatcccgatgcccctggcgagatggtggtgctgacctgcgacacacctgaggaggatggcatcacctggacactggatcagagctccgaggtgctgggaagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtctagccggggctcctctgacccacagggagtgacatgcggagcagccaccctgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctcgccaggtggaggtgagctgggagtacccagacacctggtccacaccccactcttatttcagcctgaccttttgcgtgcaggtgcagggcaagtccaagcgggagaagaaggacagagtgttcaccgataagacatctgccaccgtgatctgtcggaagaacgcctccatctctgtgagggcccaggatcgctactattctagctcctggagcgagtgggcatccgtgccatgttct

SEQ ID NO: 442 - DNA, 918 bp, Artificial Sequence
  source: /note="Description of Artificial Sequence: Synthetic construct"
atctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagc

SEQ ID NO: 443 - DNA, 918 bp, Artificial Sequence
  source: /note="Description of Artificial Sequence: Synthetic construct"
atctgggagctgaagaaggacgtgtacgtggtggagctggactggtatcccgatgcccctggcgagatggtggtgctgacctgcgacacacccgaggaggatggcatcacctggacactggatcagtctagcgaggtgctgggctccggcaagaccctgacaatccaggtgaaggagttcggcgacgccggccagtacacctgtcacaagggcggcgaggtgctgtcccactctctgctgctgctgcacaagaaggaggacggcatctggtctacagacatcctgaaggatcagaaggagcctaagaacaagaccttcctgcggtgcgaggccaagaattatagcggccggttcacctgttggtggctgaccacaatcagcaccgatctgacattttccgtgaagtcctctcggggcagctccgacccacagggagtgacatgcggagcagccaccctgtccgccgagagggtgcgcggcgataacaaggagtacgagtattccgtggagtgccaggaggactctgcctgtccagcagcagaggagagcctgccaatcgaagtgatggtggatgccgtgcacaagctgaagtacgagaattatacatctagcttctttatccgggacatcatcaagcccgatccccctaagaacctgcagctgaagcctctgaagaattctagacaggtggaggtgagctgggagtaccccgacacctggagcacacctcacagctatttctccctgaccttttgcgtgcaggtgcagggcaagtccaagagggagaagaaggaccgcgtgttcaccgataagacatctgccaccgtgatctgtcggaagaacgccagcatctccgtgagggcccaggatcgctactattcctctagctggtctgagtgggccagcgtgccctgttcc

SEQ ID NO: 444 - DNA, 918 bp, Artificial Sequence
  source: /note="Description of Artificial Sequence: Synthetic construct"
atctgggagctgaagaaggacgtgtacgtggtggagctggactggtatcctgatgccccaggcgagatggtggtgctgacatgcgacacccccgaggaggatggcatcacatggaccctggatcagtcctctgaggtgctgggctccggcaagacactgaccatccaggtgaaggagttcggcgacgccggccagtacacctgtcacaagggaggagaggtgctgagccactccctgctgctgctgcacaagaaggaggacggcatctggtccaccgacatcctgaaggatcagaaggagcccaagaacaagacattcctgagatgcgaggccaagaattatagcggcaggtttacctgttggtggctgacaaccatctccacagatctgaccttttctgtgaagagctcccggggctctagcgaccctcagggagtgacctgcggagcagccacactgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacctcctctttctttatcagagacatcatcaagccagatcctccaaagaacctgcagctgaagcccctgaagaatagcaggcaggtggaggtgtcctgggagtacccagacacatggagcaccccccacagctatttctccctgacattttgcgtgcaggtgcagggcaagtccaagcgcgagaagaaggaccgggtgttcacagataagacctctgccacagtgatctgtcgcaagaacgcctctatcagcgtgcgcgcccaggatcggtactatagctcctcttggtctgagtgggccagcgtgccttgttcc

SEQ ID NO: 445 - DNA, 918 bp, Artificial Sequence
  source: /note="Description of Artificial Sequence: Synthetic construct"
atctgggagctgaagaaggacgtgtacgtggtggagctggactggtatcccgatgcccctggcgagatggtggtgctgacctgcgacacacctgaggaggatggcatcacctggacactggatcagagctccgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatctggtccacagacatcctgaaggatcagaaggagccaaagaacaagaccttcctgaggtgcgaggccaagaattattctggcaggttcacctgttggtggctgaccacaatcagcaccgatctgacattttccgtgaagtctagccggggctcctctgacccccagggagtgacatgcggagcagccaccctgtccgccgagagggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctagacaggtggaggtgagctgggagtacccagacacctggagcacaccccactcctatttctctctgaccttttgcgtgcaggtgcagggcaagagcaagagggagaagaaggacagagtgttcaccgataagacatccgccaccgtgatctgtcggaagaacgcctccatctctgtgcgggcccaggatcgctactattctagctcctggagcgagtgggcatccgtgccatgttct

SEQ ID NO: 446 - protein, 306 aa, Artificial Sequence
  source: /note="Description of Artificial Sequence: Synthetic construct"
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPNNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 447 - DNA, 918 bp, Artificial Sequence
  source: /note="Description of Artificial Sequence: Synthetic construct"
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaacaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcaccgacaagacctcagccacggtcatctgccgcaaaaatgccagcattagcgtgcgggcccaggaccgctactatagctcatcttggagcgaatgggcatctgtgccctgcagt

SEQ ID NO: 448 - protein, 253 aa, Homo sapiens
MWPPGSASQPPPSPAAATGLHPAARPVSLQCRLSMCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 449 - DNA, 1522 bp, Homo sapiens
acggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcaccccgggagttaatccgaaagcgccgcaagccccgcgggccggccgcaccgcacgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaatt

SEQ ID NO: 450 - DNA, 759 bp, Homo sapiens
atgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggaccctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcc

SEQ ID NO: 451 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 452 - DNA, 591 bp, Artificial Sequence
  source: /note="Description of Artificial Sequence: Synthetic construct"
agaaatctgccagtggcaacccctgacccaggaatgttcccttgcctgcaccacagccagaacctgctgcgggccgtgtccaatatgctgcagaaggccagacagacactggagttttacccttgtacctctgaggagatcgaccacgaggatatcacaaaggataagaccagcacagtggaggcctgcctgccactggagctgaccaagaacgagtcctgtctgaacagccgggaaaccagcttcatcaccaacggctcctgcctggcctctcgcaagaccagcttcatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagtcctctctggaggagcccgatttctacaagaccaagatcaagctgtgcatcctgctgcacgcctttaggatccgcgccgtgaccatcgacagagtgatgtcctatctgaacgcctct

SEQ ID NO: 453 - DNA, 591 bp, Artificial Sequence
  source: /note="Description of Artificial Sequence: Synthetic construct"
agaaatctgccagtggcaacccctgacccaggaatgttcccttgcctgcaccacagccagaacctgctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagagctgtctgaattcccgggagacatctttcatcaccaacggcagctgcctggcctccagaaagacatcttttatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagtcctctctggaggagcccgatttctacaagaccaagatcaagctgtgcatcctgctgcacgcctttaggatccgcgccgtgaccatcgaccgcgtgatgtcttatctgaacgcatcc

SEQ ID NO: 454 - DNA, 591 bp, Artificial Sequence
  source: /note="Description of Artificial Sequence: Synthetic polynucleotide"
cgcaatctgccagtggcaacccctgacccaggaatgttcccttgcctgcaccacagccagaacctgctgcgggccgtgtccaatatgctgcagaaggcccgccagacactggagttttacccttgtacctctgaggagatcgaccacgaggatatcacaaaggataagaccagcacagtggaggcctgcctgccactggagctgaccaagaacgagagctgtctgaattccagggagacatctttcatcaccaacggcagctgcctggcctccagaaagacatcttttatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaattccgagacagtgccacagaagtcctctctggaggagcccgatttctacaagaccaagatcaagctgtgcatcctgctgcacgccttcaggatcagggccgtgaccatcgacagagtgatgagctatctgaacgccagc

SEQ ID NO: 455 - DNA, 591 bp, Artificial Sequence
  source: /note="Description of Artificial Sequence: Synthetic polynucleotide"
agaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagt

SEQ ID NO: 456 - DNA, 591 bp, Artificial Sequence
  source: /note="Description of Artificial Sequence: Synthetic polynucleotide"
cgcaatctgccagtggccacccctgacccaggcatgttcccctgcctgcaccacagccagaacctgctgagggccgtgtccaatatgctgcagaaggcccgccagacactggagttttacccttgtacctctgaggagatcgaccacgaggatatcacaaaggataagaccagcacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctct

SEQ ID NO: 457 - DNA, 591 bp, Artificial Sequence
  source: /note="Description of Artificial Sequence: Synthetic polynucleotide"
agaaatctgccagtggccacccctgacccaggcatgttcccctgcctgcaccactctcagaacctgctgcgggccgtgagcaatatgctgcagaaggccagacagacactggagttttacccttgtacctccgaggagatcgaccacgaggatatcacaaaggataagacctctacagtggaggcctgcctgccactggagctgaccaagaacgagtcctgtctgaacagccgggaaaccagcttcatcaccaacggctcctgcctggcctctagaaagaccagcttcatgatggccctgtgcctgtcctctatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttaggatccgcgccgtgaccatcgaccgcgtgatgtcctatctgaatgcctct

SEQ ID NO: 458 - DNA, 591 bp, Artificial Sequence
  source: /note="Description of Artificial Sequence: Synthetic polynucleotide"
agaaatctgccagtggccacccctgacccaggcatgttcccctgcctgcaccacagccagaacctgctgagggccgtgtccaatatgctgcagaaggcccgccagacactggagttttacccctgtaccagcgaggagatcgaccacgaggatatcacaaaggataagacctccacagtggaggcctgcctgcctctggagctgaccaagaacgagtcttgtctgaatagcagggagacatccttcatcaccaacggctcttgcctggccagccgcaagacatcctttatgatggccctgtgcctgtcctctatctacgaggacctgaagatgtatcaggtggagttcaagaccatgaacgccaagctgctgatggaccctaagaggcagatctttctggatcagaatatgctggccgtgatcgacgagctgatgcaggccctgaacttcaattccgagacagtgcctcagaagagctccctggaggagccagatttctacaagaccaagatcaagctgtgcatcctgctgcacgcctttcggatcagagccgtgaccatcgaccgcgtgatgtcttatctgaatgccagc

SEQ ID NO: 459 - DNA, 591 bp, Artificial Sequence
  source: /note="Description of Artificial Sequence: Synthetic polynucleotide"
cggaatctgcctgtggcaacccccgaccctggaatgttcccatgcctgcaccacagccagaacctgctgcgcgccgtgtccaatatgctgcagaaggcccggcagaccctggagttttacccatgtacaagcgaggagatcgaccacgaggatatcaccaaggataagacatccaccgtggaggcatgcctgccactggagctgacaaagaacgagtcttgtctgaacagccgggagacaagcttcatcacaaacggctcttgcctggccagccggaagacctcctttatgatggccctgtgcctgagctccatctacgaggacctgaagatgtatcaggtggagttcaagacaatgaacgccaagctgctgatggaccccaagcgccagatctttctggatcagaatatgctggccgtgatcgacgagctgatgcaggccctgaactttaatagcgagacagtgccccagaagtctagcctggaggagcctgatttctacaagacaaagatcaagctgtgcatcctgctgcacgccttccggatcagagccgtgaccatcgacagagtgatgtcttatctgaatgccagc

SEQ ID NO: 460 - DNA, 591 bp, Artificial Sequence
  source: /note="Description of Artificial Sequence: Synthetic polynucleotide"
agaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagc

SEQ ID NO: 461 - DNA, 591 bp, Artificial Sequence
  source: /note="Description of Artificial Sequence: Synthetic construct"
cgcaatctgccagtggccacccctgacccaggcatgttcccctgcctgcaccacagccagaacctgctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctct

SEQ ID NO: 462 - DNA, 594 bp, Artificial Sequence
  source: /note="Description of Artificial Sequence: Synthetic construct"
agaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaa

SEQ ID NO: 463 - DNA, 593 bp, Artificial Sequence
  source: /note="Description of Artificial Sequence: Synthetic polynucleotide"
cgcaatctgccagtggccacccctgacccaggcatgttcccctgcctgcaccacagccagaacctgctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctcttg

SEQ ID NO: 464 - protein, 193 aa, Homo sapiens
VATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 465 - protein, 486 aa, Artificial Sequence
  source: /note="Description of Artificial Sequence: Synthetic CD19 mutant sequence"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 466 - DNA, 1461 bp, Artificial Sequence
  source: /note="Description of Artificial Sequence: Synthetic CD19 mutant sequence"
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggtga

SEQ ID NO: 467 - DNA, 1461 bp, Artificial Sequence
  source: /note="Description of Artificial Sequence: Synthetic CD19 mutant sequence"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 468 - protein, 1049 aa, Artificial Sequence
  source: /note="Description of Artificial Sequence: Synthetic construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGS

SEQ ID NO: 469 - DNA, 3150 bp, Artificial Sequence
  source: /note="Description of Artificial Sequence: Synthetic construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatcctga

SEQ ID NO: 470 - DNA, 978 bp, Artificial Sequence
  source: /note="Description of Artificial Sequence: Synthetic polynucleotide"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaatttgctgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcaggaagaacaggcagaaatggcaggcccttgcagaacagcag

SEQ ID NO: 471 - DNA, 978 bp, Artificial Sequence
  source: /note="Description of Artificial Sequence: Synthetic polynucleotide"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggataggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 472 - DNA, 978 bp, Artificial Sequence
  source: /note="Description of Artificial Sequence: Synthetic polynucleotide"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggaatggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 473 - DNA, 978 bp, Artificial Sequence
  source: /note="Description of Artificial Sequence: Synthetic polynucleotide"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggacgggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 474 - DNA, 576 bp, Artificial Sequence
  source: /note="Description of Artificial Sequence: Synthetic construct"
cgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataa

SEQ ID NO: 475 - DNA, 28 bp, Artificial Sequence
  source: /note="Description of Artificial Sequence: Synthetic Spacer sequence"
tctagataatacgactcactagagatcc

SEQ ID NO: 476 - DNA, 16 bp, Artificial Sequence
  source: /note="Description of Artificial Sequence: Synthetic Spacer sequence"
tatggccacaaccatg

SEQ ID NO: 477 - DNA, 30 bp, Artificial Sequence
  source: /note="Description of Artificial Sequence: Synthetic Spacer sequence"
aatctagataatacgactcactagagatcc

SEQ ID NO: 478 - DNA, 32 bp, Artificial Sequence
  source: /note="Description of Artificial Sequence: Synthetic Spacer sequence"
gcttgccacaacccacaaggagacgaccttcc

SEQ ID NO: 479 - DNA, 11 bp, Artificial Sequence
  source: /note="Description of Artificial Sequence: Synthetic Spacer sequence"
atcgggctagc

SEQ ID NO: 480 - protein, 486 aa, Artificial Sequence; identical to SEQ ID NO: 465
  source: /note="Description of Artificial Sequence: Synthetic construct"

SEQ ID NO: 481 - protein, 542 aa, Artificial Sequence
  source: /note="Description of Artificial Sequence: Synthetic construct"
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGS

SEQ ID NO: 482 - DNA, 3709 bp, Artificial Sequence
  source: /note="Description of Artificial Sequence: Synthetic construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaaatcgggctagccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacaaggagacgaccttccatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatcctaa

SEQ ID NO: 483 - DNA, 1461 bp, Artificial Sequence; identical to SEQ ID NO: 467
  source: /note="Description of Artificial Sequence: Synthetic construct"

SEQ ID NO: 484 - DNA, 1629 bp, Artificial Sequence
  source: /note="Description of Artificial Sequence: Synthetic construct"
atgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatcctaa

SEQ ID NO: 485 - DNA, 978 bp, Artificial Sequence
  source: /note="Description of Artificial Sequence: Synthetic polynucleotide"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtgtggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 486 - DNA, 591 bp, Artificial Sequence
  source: /note="Description of Artificial Sequence: Synthetic Construct"
agaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgcctcc

SEQ ID NO: 487 - protein, 19 aa, Artificial Sequence
  source: /note="Description of Artificial Sequence: Synthetic Linker"
SGGGSGGGGSGGGGSGGGG

SEQ ID NO: 488 - protein, 542 aa, Artificial Sequence; identical to SEQ ID NO: 481
  source: /note="Description of Artificial Sequence: Synthetic Construct"

SEQ ID NO: 489 - DNA, 1629 bp, Artificial Sequence; identical to SEQ ID NO: 484
  source: /note="Description of Artificial Sequence: Synthetic Construct"

SEQ ID NO: 490 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRDGEFSELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 491 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggatggagaatttagtgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 492 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKREGEFDELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 493 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggagggagaatttgatgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 494 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRVGEFGELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 495 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggttggagaatttggtgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 496 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRWGEFGELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 497 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtggggagaatttggggaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 498 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRWGEFVELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 499 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtggggagaatttgttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 500 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFWELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 501 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggttgggagaattttgggaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 502 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRPGEFQELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 503 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggccgggagaatttcaggaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 504 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRAGEFAELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 505 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggctggagaatttgcggaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 506 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRSGEFGELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 507 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtctggagaatttggggaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 508 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRTGEFPELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 509 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggacgggagaatttccggaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 510 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRMGEFHELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 511 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggatgggagaatttcatgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 512 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRYGEFMELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 513 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtatggagaatttatggaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 514 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRPGEFDELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 515 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcctggagaatttgatgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 516 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRPGEFGELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 517 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcctggagaatttggggaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 518 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRWGEFLELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 519 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtggggagaatttttggaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 520 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFSELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 521 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggttgggagaatttagtgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 522 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRDGEFTELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 523 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggatggagaatttacggaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 524 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFVELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 525 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggttgggagaatttgttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 526 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRGGEFVELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 527 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagagggggggagaatttgttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 528 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRWGEFAELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 529 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggtggggagaatttgctgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 530 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALNTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 531 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgaatacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 532 - protein, 326 aa, Artificial Sequence
  source: /note="Description of Artificial Sequence: Synthetic Destabilizing Domain (DD)"
EKTRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELWRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 533 - DNA, 978 bp, Artificial Sequence
  source: /note="Description of Artificial Sequence: Synthetic Destabilizing Domain (DD)"
gaaaaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaactttggagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 534 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCFSIMEHHHFDQCLMILNSPGNQILFGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 535 - DNA, 978 bp, Artificial Sequence
  source: /note="Description of Artificial Sequence: Synthetic Destabilizing Domain (DD)"
gaagaaacaagagagctacagtcgttagcggctgctgtggtaccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgcttttcaatcatggaacaccatcattttgaccagtgcctgatgattcttaatagtccaggcaatcagattctctttggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 536 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSGHPLAQLYCHSIMEHHHFDQCLMILNSPGNQTLSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 537 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctagaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtggacatccacttgcccagctttactgccattcaatcatggaacaccatcattttgaccagtgcctgatgattcttaatagtccaggcaatcagactctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagacgccatctgcttgcaactgtatgaggccctgacccacgtgtcagaggactgtttccctttgctagatggctgcagaaagaacaggcagaaatggcaggcccttgcagaacagcag

SEQ ID NO: 538 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKASKIQNKLTDLEILALLTAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 539 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaagcaaaattcagaacaagctgactgacctggagatacttgcattgctgactgctgcactaagccacgatttggatcaccgtggtgtgaataactcttacatacagcgaagtgaacatccacttgcccagctttactgccactcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 540 - protein, 240 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILASLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPI

SEQ ID NO: 541 - DNA, 720 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcatcgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaaccagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctatt

SEQ ID NO: 542 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTVCDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 543 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagtttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 544 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTNLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 545 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattaccggaagaatgttgcctatcataattggagacatgcctttaatacagctcagtgcatgttcgctgctctaaaagcaggcaaaattcagaacaagctgactaacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctaacccacgtgtcagaggactgtttccctttgctagatggctgcagaaagaacaggcagaaatggcaggcccttgcagaacagcag

SEQ ID NO: 546 - protein, 326 aa, Artificial Sequence; identical to SEQ ID NO: 104
  source: /note="Description of Artificial Sequence: Synthetic Destabilizing Domain (DD)"

SEQ ID NO: 547 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagagcaagctgactgacctggagatacttgcattgctgattgctgcactaagccacgatttggatcaccgtggtgtgaataactcttacatacagcgaagtgagcatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 548 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTARCMFAALKAGKIQNKLTDLEILALLIAALSHGLDHRGVNNSYIQRSEHPLAQLYCHSIMEHHHFDQCLMILNSPGNQILSGLSIEEYKTTLKIIKQAILATDLALYIKRRGEFFELIRNNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 549 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcggtgcatgtttgctgctctaaaagcaggcaaaattcagaacaagctgactgacctggagatacttgcattgctgattgctgcactaagccacggtttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaacaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 550 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLTQLYCHSIMEHHHFDQCLMILNSPGNQILSGLSIEEYKTTLKIIKQAILATDLALYIKRRGEFFELIRKNQFNLEDPHQKELFVAMLMTACDLSAITKPWPIQQRIAELVATEFFDQGDRERKELNIEPTDLMNREKKNKIPSMQVGFIDAICLQLYEALTHVSEDCFPLLDGYRKNRQKWQALAEQQ

SEQ ID NO: 551 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttacccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttgtggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctacagaaagaacaggcagaaatggcaggcccttgcagaacagcag

SEQ ID NO: 552 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGANNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAEFVATEFFDQGDREGKELNIEPTDLMNREKKNKIPSMQVGFIDAIRLQLYEALTHVSEDCFPLLDGCRKNRQKWQALAGQQ

SEQ ID NO: 553 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaatcactgactttagcttcagtgactttgagctgtctgatctggaaacggcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgcgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaatttgtagcaactgaattttttgatcaaggagacagagagggaaaagaactcaacatagaacccactgatctaatgaacagggagaagaaaaacaaaatcccaagtatgcaagttgggttcatagatgccatccgcttgcaactgtatgaggccctgacccacgtgtcagaggactgtttccctttgctagatggctgcagaaagaacaggcagaaatggcaggcccttgcaggacagcag

SEQ ID NO: 554 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLGILALLIAALSHDLDHRGVNNSYIQRSEHPLAQLYCHSIMEHHHFDQCLMILNSPDNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKTPSMQVGFIDAICLQLYEALTHVSEDCFPLLDGCRKNRQKWQALAEQQ

SEQ ID NO: 555 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggggatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccagacaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagagctcaacatagaacccactgatctaatgaacagggagaagaaaaacaaaaccccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 556 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLATLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 557 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgccctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaacgctgatgacagcttgtgatctttctgcaattacaaaaccctggcctattcaacaacgaatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 558 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQEELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 559 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaagaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccgagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 560 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYYHSIMEHHRFDQCLMILNSPGNQILSGLSIEEYKTTLKIIKQAILVTDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 561 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcattgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgttgattgctgcactaagccacgatttggatcaccgtggtgtgaataactcttacatacagcgaagtgaacatccacttgcccagctttactaccattcaatcatggaacaccatcgttttgaccagtgcctgatgattcttaatagtccaggcaatcagattctcagtggcctctccattgaagaatataagaccacgttgaaaataatcaagcaagctattttagttacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 562 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLSDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSRQVGFIDAICLQLYEALTHVSEDCFPLLDGCRKNRQKWQALAEQQ

SEQ ID NO: 563 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgtctgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgatccttaatagtccaggcaatcagattctcagtggcctctccattgaagaatataagaccacgttgaaaataatcaagcaagctattttagctacagacctagcgctgtacattaagaggcgaggagaattttttgaacttataagaaaaaatcaattcaatttggaagatcctcatcagaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtaggcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 564 - protein, 326 aa, Artificial Sequence
  source: /note="Description of Artificial Sequence: Synthetic Destabilizing Domain (DD)"
EEARELQSLAAAVVPSAQTLKITGFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSTEEYKTTLKIIKQAILATDLALYIKRRGEFFELIRKNQLNLEDPHQKELFLAMLMTACNLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 565 - DNA, 978 bp, Artificial Sequence
  source: /note="Description of Artificial Sequence: Synthetic Destabilizing Domain (DD)"
gaagaagcaagagagctacagtcgttagcggctgctgtggtgccatctgcccagacccttaaaattactggctttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccactgaagaatataagaccacgttgaaaataatcaagcaagctattttagctacagacctagcactgtacattaagaggcgaggagaattttttgaacttataagaaaaaatcaactcaatttggaagatcctcatcaaaaggagttgtttttggcaatgctgatgacagcttgcaatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcagctgtatgaggccctgacccacgtgtcagaggactgtttccctttgctagatggctgcagaaagaacaggcagaaatggcaggcccttgcagaacagcag

SEQ ID NO: 566 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVRNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATGLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 567 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcggaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacaggcctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctggatggctgcagaaagaacaggcagaaatggcaggcccttgcagaacagcag

SEQ ID NO: 568 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHSDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 569 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattctgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 570 - protein, 326 aa, Artificial Sequence
  source: /note="Description of Artificial Sequence: Synthetic Destabilizing Domain (DD)"
EETRGLQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFEIIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 571 - DNA, 978 bp, Artificial Sequence
  source: /note="Description of Artificial Sequence: Synthetic Destabilizing Domain (DD)"
gaagaaacaagagggctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaaattataagaaaaaatcaattcaatttggaagatcctcatcaaaaggagttgtttttggcaatgctgatgacagcttgtgatctttctgcaattacaaaaccctggcctattcaacaacggatagcagaacttgtagcaaccgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcaggaagaacaggcagaaatggcaggcccttgcagaacagcag

SEQ ID NO: 572 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIRNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKKLFLAMLMTACDLSAITKPWPIQQRIAELVATEFFDQGDRERKELNIEPTDLMNREKKNKTPSMQVGFIDAICLQLYEALTHVSEDCFPLLDGCRKNRQKWQALAEQQ

SEQ ID NO: 573 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcggaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaagaagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaaccccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 574 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPPAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVLEDCFPLLDGCRKNRQKWQALAEQQ

SEQ ID NO: 575 - DNA, 978 bp, Artificial Sequence
  source: /note="Description of Artificial Sequence: Synthetic Destabilizing Domain (DD)"
gaagaaacaagagagctacagtcgttagcggctgccgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctaactgacctggagatacttgcattgctgattgctgcactaagccacgatttggatcaccgtggtgtgaataactcttacatacagcgaagtgaacatccacctgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgttagaggactgtttccctttgctagatggctgcagaaagaacaggcagaaatggcaggcccttgcagaacagcag

SEQ ID NO: 576 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLTILNSPGNQILSGLSIEEYKTTLKIIKQAILATDLALYIKRRGEFFELIRKNQFNLEDPHQKELFLAMLMTACNLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 577 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgacgattcttaatagtccaggcaatcagattctcagtggcctctccattgaagaatataagaccacgttgaaaataatcaagcaagctattttagctacagacctagcactgtacattaagaggcgaggagagttttttgaacttataagaaaaaatcaattcaatttggaagatcctcatcaaaaggagttgtttttggcaatgctgatgacagcttgtaatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 578 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNGEKKNKIPSMQVGFIDAICLQLYEALTHVSEDCFPLLDGCRKNRQKWQALAEQQ

SEQ ID NO: 579 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgatcgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgccattacaaaaccctggcctattcaacaacggatagcagaacttgtagcaactgaattttttgatcaaggagacagagagagaaaagaactcaacatagaacccactgatctaatgaacggggagaagaaaaacaagatcccaagtatgcaagttgggttcatagatgccatctgcttgcaactgtatgaggccctgacccacgtgtcagaggactgtttcccattgctagatggctgcagaaagaacaggcagaaatggcaggcccttgcagaacagcag

SEQ ID NO: 580 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIQMFTDLNLVQNFQMKHEVLRRWILSVKKNYRKNVAYHNWRHAFNTAQCMFAALKAGKIQNKLTDLEILALLIAALSHDLDHRGANNSYIQRSEHPLAQLYCHSIMEHHHFDQCLMILNSPGNQILSGLSIEEYKTTLKVIKQAILATDLALYIKRRGEFFELIRKNQFNLEDPHQKELFLAMLMTACDLSAITKPWPIQQRIAELVATKFFDQGDRERKELNIEPTDLMNREKKNKIPSMQVGFIDAICLQLYEALTHVSEDCFPLLDGCRKNRQKWQAPAEQQ

SEQ ID NO: 581 - DNA, 978 bp, Artificial Sequence
  source: /note="Description of Artificial Sequence: Synthetic Destabilizing Domain (DD)"
gaagaaacaagagagctacagtcgttggcggctgctgtggtgccatctgcccagacccttaaaattactgactttagcttcagtgactttgagttgtctgatctggaaacagcactgtgtacaattcagatgtttactgacctcaaccttgtgcagaacttccagatgaaacatgaggttcttcgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgcgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaagtaatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactaaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccctgcagaacagcag

SEQ ID NO: 582 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAVLATDLALYIKRRGEFFELIRKNQFNLEDPHQKELFLAMLMTACDLSAITKPWPIQQRIAELVATEFFDQGDRERKELNIEPTDLMNREKKNKIPSMQVGSIDAICLQLYEALTHVSEDCFPLLDGCRKNRQKWQALAEQQ

SEQ ID NO: 583 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgacttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctgttttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggtccatagatgccatctgcttgcaactgtatgaggccctgacccacgtgtcagaggactgtttccctttgctagatggctgcagaaagaacaggcagaaatggcaggcccttgcagaacagcag

SEQ ID NO: 584 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNGPGNQILSGLSIKEYKTTLKIIKQAILATDLALYIKRRGEFFELMRKNQFNLEDPHQKELFLAMLMTARDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 585 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataactggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatggtccaggcaatcagattctcagtggcctctccattaaagaatataagaccacgttgaaaataatcaagcaagctattttagctacagacctagcactgtacattaagaggcgaggagaattttttgaacttatgagaaaaaatcaattcaatttggaagatcctcatcaaaaggagttgtttttggcaatgctgatgacagctcgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 586 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEHKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNRIPSMQVGFIDAICLQLYEAPTHVSEDCFPLLDGCRKNRQKWQALAEQQ

SEQ ID NO: 587 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccactcgcccagctttactgccattcaatcatggaacaccatcattttgaccagtgcctgatgattcttaatagtccaggcaatcagattctcagtggcctctccattgaagaacataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacagaatcccaagtatgcaagttgggttcatagatgccatctgcttgcaactgtatgaggccccgacccacgtgtcagaggactgtttccctttgctagatggctgcagaaagaacaggcagaaatggcaggcccttgcagaacagcag

SEQ ID NO: 588 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLSLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQEELFLAMLMTACDLSAITKPWPIQQRIAELVATEFFDQGDRERKELNIEPTDLMNREKKNKIPSMQVGFIDAICLQLYEALTHVSEDCFPLLDGSRKNRQKWQALAEQQ

SEQ ID NO: 589 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcagccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactatacattaagaggcgaggagaattttttgaacttataagaaaaaatcaattcaatttggaagatcctcatcaagaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctccagaaagaacaggcagaaatggcaggcccttgcagaacagcag

SEQ ID NO: 590 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMGHHHFDQCLMILNSPGNQILSGLSIEEYKTTLKIIKQAILATDLALYIKRRGEFFELIRKNQFNLENPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 591 - DNA, 978 bp, Artificial Sequence
  source: /note="Description of Artificial Sequence: Synthetic Destabilizing Domain (DD)"
gaagaaacaagagagctacagtcgttagcggctgctgtggtgccatccgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaattatgggacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaaaatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 592 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMRHEVLCRWILSVKKNYRKNVAYHNWRHAFNTAQCMFAALKAGKIQNKLTDLETLALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQAPAEQQ

SEQ ID NO: 593 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgagacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagacacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgcttccctttgctagatggctgcagaaagaacaggcagaaatggcaggcccctgcagaacagcag

SEQ ID NO: 594 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHASNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQAGFIDAICLQLCEALTHVSEDCFPLLDGCRKNRQKWQALAEQQ

SEQ ID NO: 595 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataactggagacatgcctctaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagctgggttcatagatgccatctgcttgcaactgtgtgaggccctgacccacgtgtcagaggactgtttccctttgctagatggctgcagaaagaacaggcagaaatggcaggcccttgcagaacagcag

SEQ ID NO: 596 - protein, 326 aa, Artificial Sequence
  source: /note="Description of Artificial Sequence: Synthetic Destabilizing Domain (DD)"
EETRELQSLAAAVEPSAQTLKITDFSFSDFELSDLETALCTIRMFTDLNLVQNFLMKHEVLCRWILSVKKNYRKNVAYHNWRHAFNTAQCMFAALKAGIIQNKLTDLEILALLIAALSHDLDHRGVNNSYIQRSEHPLAQLYCHSITEHHHFDQCLMILNSPGNQILIGLSIEEYKTTLKIIKQAILATDLALYIKRRGEFFELIRKNQFNLEDPHQEELFLAMLMTACDLSAITKPWPIQQRIAEPVATEFFDQGDRERKELNIEPTDLMNREKKNKIPSMQVGFIDAICLQLYEALTHVSEDCFPLLDGCRKNRQKWQALTEQQ

SEQ ID NO: 597 - DNA, 978 bp, Artificial Sequence
  source: /note="Description of Artificial Sequence: Synthetic Destabilizing Domain (DD)"
gaagaaacaagagagctacagtcgttagcggctgctgtggagccatctgcccagacccttaaaattactgactttagcttcagtgactttgagctgtctgatctggaaacagcactgtgtacaattcggatgtttactgacctcaaccttgtgcagaacttcctgatgaaacatgaggttctttgcagatggattttaagtgttaagaagaattatcggaagaatgttgcctatcataattggagacatgcctttaatacagctcagtgcatgtttgctgctctaaaagcaggcataattcagaacaagctgactgacctggagatacttgcattgctgattgctgcactaagccacgatttggatcaccgtggtgtgaataactcttacatacagcgaagtgaacatccacttgcccagctttactgccattcaatcacggaacaccatcattttgaccagtgcctgatgattcttaatagtccaggcaatcagattctcattggcctctccattgaagaatataagaccacgttgaaaataatcaagcaagctattttagctacagacctagcactgtacattaagaggcgaggagaattttttgaacttataagaaaaaatcaattcaatttggaagatcctcatcaagaggagttgtttttggcaatgctgatgacagcttgtgatctttctgcaattacaaaaccctggcctattcaacaacggatagcagaacctgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttacagaacagcag

SEQ ID NO: 598 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALGHDLDHRGVNNSYIQRSEHPLAQLYCHSIMEHHHFDRCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 599 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaggccacgatttggatcaccgtggtgtgaataactcttacatacagcgaagtgaacatccacttgcccagctttactgccattcaatcatggaacaccatcattttgaccggtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 600 - protein, 326 aa, Artificial Sequence
  source: /note="Description of Artificial Sequence: Synthetic Destabilizing Domain (DD)"
EETRELQSLAAAVVPSAQTLKITDFSFSDFGLSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 601 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgggctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagccattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 602 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPVQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 603 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctgttcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 604 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMRHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 605 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgagacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 606 - protein, 326 aa, Artificial Sequence
  source: /note="Description of Artificial Sequence: Synthetic Destabilizing Domain (DD)"
EETRELQSLAAAVVPSAQTLKITDSSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEECKTTLKIIKQAILATDLALYIKRRGEFFELIRKNQFNLEDPHQKELFLAMLTTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 607 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactctagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatgtaagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgacgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgttagatggctgcagaaagaacaggcagaaatggcaggcccttgcagaacagcag

SEQ ID NO: 608 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIVTLSHDLDHRGVNNSYIQRSEHPLAQLYCHSIMEHHHFDQCLMILNSPGNQILSGLSIEEYKTTLKIIKQAILATDLALYIERRGEFFELIRKNQFNLEDPHQKELFLAMLMTACDLSAITKPWPIQQRIAELVATEFFDQGDRERKELNIEPTDLMNREKKNKIPSMQVGFIDAICLQLYKALTHVSEDCFPLLDGCRKNRQKWQALAEQQ

SEQ ID NO: 609 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgttacactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattgagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaatatagaacccactgatctaatgaacagggagaagaaaaacaaaatcccaagtatgcaagttgggttcatagatgccatctgcttgcaactgtataaggccctgacccacgtgtcagaggactgcttccctttgctagatggctgcagaaagaacaggcagaaatggcaggcccttgcagaacagcag

SEQ ID NO: 610 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALCIKRRGEFFELIRKNQFNLEDPHQKELFLAMLMTACDLSAITKPWPIQQRIAELVATEFFDQGDRERKELNIEPTDLMNREKKNKIPSMRVGFIDAICLQLYEALTHVSEDCFPLLDGCRKNRQKWQALAEQQ

SEQ ID NO: 611 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtgcattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcgagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 612 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIRMFTDLNLVQNFQMKHEVPCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRRNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 613 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttccttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccactcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaagaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcag

SEQ ID NO: 614 - protein, 326 aa, Artificial Sequence
  source: /note="Description of Artificial Sequence: Synthetic Destabilizing Domain (DD)"
EETRELQSLAAAVVPSAQTLKITDFSFSDFELSDLETALCTIWMFTDLNLVQNFQMKHEVLCRWILSVKKNYRKNVAYHNRRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLTNREKKNKIPSMQVGFVDAICLQLYEALTHVSEDCFPLLDGCRKNRQKWQALAEQQ

SEQ ID NO: 615 - DNA, 978 bp, Artificial Sequence
  source: /note="Description of Artificial Sequence: Synthetic Destabilizing Domain (DD)"
gaagaaacaagagagctacagtcgttagcggctgctgtggtgccatctgcccagacccttaaaattactgactttagcttcagtgactttgagctgtctgatctggaaacagcactgtgtacaatttggatgtttactgacctcaaccttgtgcagaacttccagatgaaacatgaggttctttgcagatggattttaagtgttaagaagaattatcggaagaatgttgcctatcataatcggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaacgaacagggagaagaaaaacaaaatcccaagtatgcaagttgggttcgtagatgccatctgcttgcaactgtatgaggccctgacccacgtgtcagaggactgtttccctttgctagatggctgcagaaagaacaggcagaaatggcaggcccttgcagaacagcag

SEQ ID NO: 616 - protein, 30 aa, Artificial Sequence
  source: /note="Description of Artificial Sequence: Synthetic Linker"
GSGSGSGSGSGSGSGSGSGSGSGSGSGSGS

SEQ ID NO: 617 - protein, 641 aa, Artificial Sequence
  source: /note="Description of Artificial Sequence: Synthetic Construct"
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSGSGSGSGSGSGSGSGSGSGSGSTTTPAPRPPTPAPTIASQPLSLRPEACRPAAGGAVHTRGLDFACDIYIWAPLAGTCGVLLLSLVITLYCGS

SEQ ID NO: 618 - protein, 968 aa, Artificial Sequence
  source: /note="Description of Artificial Sequence: Synthetic Construct"
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSGSGSGSGSGSGSGSGSGSGSGSTTTPAPRPPTPAPTIASQPLSLRPEACRPAAGGAVHTRGLDFACDIYIWAPLAGTCGVLLLSLVITLYCGSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 619 - protein, 1148 aa, Artificial Sequence
  source: /note="Description of Artificial Sequence: Synthetic Construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSGSGSGSGSGSGSGSGSGSGSGSTTTPAPRPPTPAPTIASQPLSLRPEACRPAAGGAVHTRGLDFACDIYIWAPLAGTCGVLLLSLVITLYCGS

SEQ ID NO: 620 - protein, 1475 aa, Artificial Sequence
  source: /note="Description of Artificial Sequence: Synthetic Construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSGSGSGSGSGSGSGSGSGSGSGSTTTPAPRPPTPAPTIASQPLSLRPEACRPAAGGAVHTRGLDFACDIYIWAPLAGTCGVLLLSLVITLYCGSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 621 - protein, 1475 aa, Artificial Sequence
  source: /note="Description of Artificial Sequence: Synthetic Construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSGSGSGSGSGSGSGSGSGSGSGSTTTPAPRPPTPAPTIASQPLSLRPEACRPAAGGAVHTRGLDFACDIYIWAPLAGTCGVLLLSLVITLYCGSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSADLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 622 - DNA, 90 bp, Artificial Sequence
  source: /note="Description of Artificial Sequence: Synthetic Linker"
ggatctggttctggttccggaagtggatctggttcagggtccggtagtggatctgggtcaggaagtggaagcggtagtgggtctggatct

SEQ ID NO: 623 - DNA, 90 bp, Artificial Sequence
  source: /note="Description of Artificial Sequence: Synthetic Linker"
ggatccggttctggttccggaagtggatctggttcagggtccggtagtggatctgggtcaggaagtggaagcggtagtgggtctggatct

SEQ ID NO: 624 - DNA, 1926 bp, Artificial Sequence
  source: /note="Description of Artificial Sequence: Synthetic Construct"
atgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatccggttctggttccggaagtggatctggttcagggtccggtagtggatctgggtcaggaagtggaagcggtagtgggtctggatctaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcggatcctga

SEQ ID NO: 625 - DNA, 2907 bp, Artificial Sequence
  source: /note="Description of Artificial Sequence: Synthetic Construct"
atgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatccggttctggttccggaagtggatctggttcagggtccggtagtggatctgggtcaggaagtggaagcggtagtgggtctggatctaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcggatctggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 626 - DNA, 3447 bp, Artificial Sequence
  source: /note="Description of Artificial Sequence: Synthetic Construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtggatctggttcagggtccggtagtggatctgggtcaggaagtggaagcggtagtgggtctggatctaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcggatcctga

SEQ ID NO: 627 - DNA, 4428 bp, Artificial Sequence
  source: /note="Description of Artificial Sequence: Synthetic Construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtggatctggttcagggtccggtagtggatctgggtcaggaagtggaagcggtagtgggtctggatctaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcggatctggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 628 - DNA, 4428 bp, Artificial Sequence
  source: /note="Description of Artificial Sequence: Synthetic Construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtggatctggttcagggtccggtagtggatctgggtcaggaagtggaagcggtagtgggtctggatctaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcggatccggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagcgccgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 629 - protein, 20 aa, Artificial Sequence
  source: /note="Description of Artificial Sequence: Synthetic Signal Sequence"
ALPVTALLLPLALLLHAARP

SEQ ID NO: 630 - DNA, 60 bp, Artificial Sequence
  source: /note="Description of Artificial Sequence: Synthetic Signal Sequence"
gccttaccagtgaccgccttgctcctgccgctggccttgctgctccacgccgccaggccg

SEQ ID NO: 631 - DNA, 60 bp, Artificial Sequence
  source: /note="Description of Artificial Sequence: Synthetic Signal Sequence"
gcactgcctgtgaccgccctgctgctgccactggccctgctgctgcacgcagccaggccc

SEQ ID NO: 632 - protein, 21 aa, Artificial Sequence
  source: /note="Description of Artificial Sequence: Synthetic Signal Sequence"
CHQQLVISWFSLVFLASPLVA

SEQ ID NO: 633 - DNA, 63 bp, Artificial Sequence
  source: /note="Description of Artificial Sequence: Synthetic Signal Sequence"
tgccaccaacagctcgtgatcagctggttctccctggtgttcctggctagccccctggtggcc

SEQ ID NO: 634 - protein, 23 aa, Artificial Sequence
  source: /note="Description of Artificial Sequence: Synthetic shedding site"
LAELRESTSQMHTASSLEKQIGH

SEQ ID NO: 635 - DNA, 69 bp, Artificial Sequence
  source: /note="Description of Artificial Sequence: Synthetic shedding site"
ctcgccgagctgcgagagtccacgagtcaaatgcacacagcgagctcacttgagaaacaaatcggccac

SEQ ID NO: 636 - protein, 12 aa, Artificial Sequence
  source: /note="Description of Artificial Sequence: Synthetic shedding site"
SPLAQAVRSSSR

SEQ ID NO: 637 - DNA, 36 bp, Artificial Sequence
  source: /note="Description of Artificial Sequence: Synthetic shedding site"
tctccgttggctcaagcggtaagaagttcctccaga

SEQ ID NO: 638 - DNA, 24 bp, Artificial Sequence
  source: /note="Description of Artificial Sequence: Synthetic Linker"
ggatctggttctggttccggaagt

SEQ ID NO: 639 - protein, 11 aa, Artificial Sequence
  source: /note="Description of Artificial Sequence: Synthetic Linker"
GSGSGSGSGSG

SEQ ID NO: 640 - DNA, 33 bp, Artificial Sequence
  source: /note="Description of Artificial Sequence: Synthetic Linker"
ggatctggttcagggtccggtagtggatctggg

SEQ ID NO: 641 - protein, 30 aa, Artificial Sequence; identical to SEQ ID NO: 616
  source: /note="Description of Artificial Sequence: Synthetic Linker"

SEQ ID NO: 642 - DNA, 90 bp, Artificial Sequence; identical to SEQ ID NO: 622
  source: /note="Description of Artificial Sequence: Synthetic Linker"

SEQ ID NO: 643 - protein, 103 aa, Artificial Sequence
  source: /note="Description of Artificial Sequence: Synthetic Construct"
ADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 644 - DNA, 309 bp, Artificial Sequence
  source: /note="Description of Artificial Sequence: Synthetic Construct"
gccgacttcccaacgccaagtatttcagattttgagatacccactagcaatataagacgcatcatctgttcaacctctgggggtttccccgagccccatctgtcttggctggaaaacggggaagaacttaatgctataaacactactgtttctcaagatcccgaaactgaactctatgctgtatccagcaaactcgacttcaatatgactacgaaccattcctttatgtgtcttattaagtatggccacttgcgcgtcaaccaaacctttaattggaatactactaaacaagagcactttcctgataac

SEQ ID NO: 645 - protein, 8 aa, Artificial Sequence
  source: /note="Description of Artificial Sequence: Synthetic Construct"
KQEHFPDN

SEQ ID NO: 646 - DNA, 24 bp, Artificial Sequence
  source: /note="Description of Artificial Sequence: Synthetic Construct"
aaacaagagcactttcctgataac

SEQ ID NO: 647 - protein, 21 aa, Artificial Sequence
  source: /note="Description of Artificial Sequence: Synthetic Construct"
LLPSWAITLISVNGIFVICCL

SEQ ID NO: 648 - DNA, 63 bp, Artificial Sequence
  source: /note="Description of Artificial Sequence: Synthetic Construct"
ctgttgccgagctgggcgattacgcttatcagtgtaaacggcatctttgtaatatgctgtctg

SEQ ID NO: 649 - protein, 12 aa, Artificial Sequence
  source: /note="Description of Artificial Sequence: Synthetic Construct"
TYCFAPRCRERR

SEQ ID NO: 650 - DNA, 36 bp, Artificial Sequence
  source: /note="Description of Artificial Sequence: Synthetic Construct"
acctactgcttcgcaccaaggtgccgggagagaagg

SEQ ID NO: 651 - protein, 227 aa, Artificial Sequence
  source: /note="Description of Artificial Sequence: Synthetic Construct"
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 652 - DNA, 681 bp, Artificial Sequence
  source: /note="Description of Artificial Sequence: Synthetic Construct"
gacaagacccatacttgccctccgtgccctgcgccggaactgctcggaggtcctagcgtctttcttttcccgccaaaacctaaggatacactcatgattagtcgaacccccgaagtgacgtgtgtagtcgtagacgttagccacgaagaccccgaagttaagttcaattggtacgtggatggcgtcgaggtacataacgctaaaaccaagcctcgagaggagcaatataactccacataccgagtggtctctgtgcttacggtgcttcaccaagattggctcaatggcaaagagtataagtgcaaggtgtctaataaggctctccctgctcccatagaaaagacgataagcaaagcaaagggacagccccgcgagccacaggtatacactctgccgccttctcgagatgagttgactaaaaaccaggtttccctcacctgtttggtcaaaggtttctatccgtctgacatcgctgtcgagtgggagagtaatggacagcctgagaacaactataagaccactccaccggtcttggacagcgatggatctttttttctgtactcaaaacttacagtagacaagtcacgatggcagcagggaaatgtcttttcctgctctgtaatgcacgaagcattgcataaccactatacgcagaaatccctttcattgtctccgggtaaa

SEQ ID NO: 653 - protein, 37 aa, Artificial Sequence
  source: /note="Description of Artificial Sequence: Synthetic Construct"
FSIPQANHSHSGDYHCTGNIGYTLYSSKPVTITVQAP

SEQ ID NO: 654 - DNA, 111 bp, Artificial Sequence
  source: /note="Description of Artificial Sequence: Synthetic Construct"
ttttctatcccgcaagcgaatcacagccattctggtgattaccactgcacgggcaatatcggttacacactctactcctcaaagcccgtcacgataacggtgcaggcacca

SEQ ID NO: 655 - protein, 6 aa, Artificial Sequence
  source: /note="Description of Artificial Sequence: Synthetic Construct"
LDFACD

SEQ ID NO: 656 - DNA, 18 bp, Artificial Sequence
  source: /note="Description of Artificial Sequence: Synthetic Construct"
ctggactttgcctgcgat

SEQ ID NO: 657 - protein, 1193 aa, Artificial Sequence
  source: /note="Description of Artificial Sequence: Synthetic Construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRGS

SEQ ID NO: 658 - DNA, 3582 bp, Artificial Sequence
  source: /note="Description of Artificial Sequence: Synthetic Construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtgccgacttcccaacgccaagtatttcagattttgagatacccactagcaatataagacgcatcatctgttcaacctctgggggtttccccgagccccatctgtcttggctggaaaacggggaagaacttaatgctataaacactactgtttctcaagatcccgaaactgaactctatgctgtatccagcaaactcgacttcaatatgactacgaaccattcctttatgtgtcttattaagtatggccacttgcgcgtcaaccaaacctttaattggaatactactaaacaagagcactttcctgataacctgttgccgagctgggcgattacgcttatcagtgtaaacggcatctttgtaatatgctgtctgacctactgcttcgcaccaaggtgccgggagagaaggggatcctga

SEQ ID NO: 659 - protein, 1325 aa, Artificial Sequence
  source: /note="Description of Artificial Sequence: Synthetic Construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKQEHFPDNLLPSWAITLISVNGIFVICCLTYCFAPRCRERRGS

SEQ ID NO: 660 - DNA, 3978 bp, Artificial Sequence
  source: /note="Description of Artificial Sequence: Synthetic Construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtgacaagacccatacttgccctccgtgccctgcgccggaactgctcggaggtcctagcgtctttcttttcccgccaaaacctaaggatacactcatgattagtcgaacccccgaagtgacgtgtgtagtcgtagacgttagccacgaagaccccgaagttaagttcaattggtacgtggatggcgtcgaggtacataacgctaaaaccaagcctcgagaggagcaatataactccacataccgagtggtctctgtgcttacggtgcttcaccaagattggctcaatggcaaagagtataagtgcaaggtgtctaataaggctctccctgctcccatagaaaagacgataagcaaagcaaagggacagccccgcgagccacaggtatacactctgccgccttctcgagatgagttgactaaaaaccaggtttccctcacctgtttggtcaaaggtttctatccgtctgacatcgctgtcgagtgggagagtaatggacagcctgagaacaactataagaccactccaccggtcttggacagcgatggatctttttttctgtactcaaaacttacagtagacaagtcacgatggcagcagggaaatgtcttttcctgctctgtaatgcacgaagcattgcataaccactatacgcagaaatccctttcattgtctccgggtaaaaaacaagagcactttcctgataacctgttgccgagctgggcgattacgcttatcagtgtaaacggcatctttgtaatatgctgtctgacctactgcttcgcaccaaggtgccgggagagaaggggatcctga

SEQ ID NO: 661 - protein, 1127 aa, Artificial Sequence
  source: /note="Description of Artificial Sequence: Synthetic Construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSFSIPQANHSHSGDYHCTGNIGYTLYSSKPVTITVQAPLLPSWAITLISVNGIFVICCLTYCFAPRCRERRGS

SEQ ID NO: 662 - DNA, 3384 bp, Artificial Sequence
  source: /note="Description of Artificial Sequence: Synthetic Construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtttttctatcccgcaagcgaatcacagccattctggtgattaccactgcacgggcaatatcggttacacactctactcctcaaagcccgtcacgataacggtgcaggcaccactgttgccgagctgggcgattacgcttatcagtgtaaacggcatctttgtaatatgctgtctgacctactgcttcgcaccaaggtgccgggagagaaggggatcctga

SEQ ID NO: 663 - protein, 1476 aa, Artificial Sequence
  source: /note="Description of Artificial Sequence: Synthetic Construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSLAELRESTSQMHTASSLEKQIGHTTTPAPRPPTPAPTIASQPLSLRPEACRPAAGGAVHTRGLDFACDIYIWAPLAGTCGVLLLSLVITLYCGSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 664 - DNA, 4431 bp, Artificial Sequence
  source: /note="Description of Artificial Sequence: Synthetic Construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtctcgccgagctgcgagagtccacgagtcaaatgcacacagcgagctcacttgagaaacaaatcggccacaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcggatccggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 665 - protein, 1476 aa, Artificial Sequence
  source: /note="Description of Artificial Sequence: Synthetic Construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSSPLAQAVRSSSRGSGSGSGSGSGTTTPAPRPPTPAPTIASQPLSLRPEACRPAAGGAVHTRGLDFACDIYIWAPLAGTCGVLLLSLVITLYCGSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 666 - DNA, 4431 bp, Artificial Sequence
  source: /note="Description of Artificial Sequence: Synthetic Construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagttctccgttggctcaagcggtaagaagttcctccagaggatctggttcagggtccggtagtggatctgggaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcggatccggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 667 - protein, 1157 aa, Artificial Sequence
  source: /note="Description of Artificial Sequence: Synthetic Construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSGSGSGSGSGSGSGSGSGSGSGSTTTPAPRPPTPAPTIASQPLSLRPEACRPAAGGAVHTRGLDFACDLLPSWAITLISVNGIFVICCLTYCFAPRCRERRGS

SEQ ID NO: 668 - DNA, 3474 bp, Artificial Sequence
  source: /note="Description of Artificial Sequence: Synthetic Construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtggatctggttcagggtccggtagtggatctgggtcaggaagtggaagcggtagtgggtctggatctaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatctgttgccgagctgggcgattacgcttatcagtgtaaacggcatctttgtaatatgctgtctgacctactgcttcgcaccaaggtgccgggagagaaggggatcctga

SEQ ID NO: 669 - protein, 1118 aa, Artificial Sequence
  source: /note="Description of Artificial Sequence: Synthetic Construct"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSATNFSLLKQAGDVEENPGPMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGSGSGSGSGSGSGSGSGSGSGSGSGSGSGSLDFACDLLPSWAITLISVNGIFVICCLTYCFAPRCRERRGS

SEQ ID NO: 670 - DNA, 3357 bp, Artificial Sequence
  source: /note="Description of Artificial Sequence: Synthetic Construct"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatcagctactaacttcagcctgctgaagcaggctggagacgtggaggagaaccctggacctatgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagcggatctggttctggttccggaagtggatctggttcagggtccggtagtggatctgggtcaggaagtggaagcggtagtgggtctggatctctggactttgcctgcgatctgttgccgagctgggcgattacgcttatcagtgtaaacggcatctttgtaatatgctgtctgacctactgcttcgcaccaaggtgccgggagagaaggggatcctga

SEQ ID NO: 671 - protein, 26 aa, Artificial Sequence
  source: /note="Description of Artificial Sequence: Synthetic Linker"
SGGGSGGGGSGGGGSGGGGSGGGSLQ

SEQ ID NO: 672 - protein, 20 aa, Artificial Sequence
  source: /note="Description of Artificial Sequence: Synthetic Linker"
SGGGSGGGGSGGGGSGGGGS

SEQ ID NO: 673 - protein, 5 aa, Artificial Sequence
  source: /note="Description of Artificial Sequence: Synthetic Linker"
SGGGS

The invention claimed is:

1. A modified cell comprising an effector module, wherein said effector module comprises:
   (a) a payload of interest, said payload comprising a membrane-associated Interleukin 12 (IL12), wherein the membrane-associated IL12 is a fusion protein comprising IL12 subunit beta (p40), IL 12 subunit alpha (p35), at least one linker, and a transmembrane domain; and
   (b) a stimulus response element (SRE) comprising a region of Human phosphodiesterase 5 (hPDE5) corresponding to amino acids 535-860 of SEQ ID NO:1, wherein the region further comprises mutation R732L, and wherein the SRE is responsive to or interacts with at least one stimulus.

2. The modified cell of claim 1, wherein the p40 comprises the amino acid sequence of SEQ ID NO. 434, and wherein the p35 comprises the amino acid sequence of SEQ ID NO:464.

3. The modified cell of claim 1, wherein the stimulus is vardenafil, sildenafil or tadalafil.

4. The modified cell of claim 1, wherein the effector module further comprises a CD 19 chimeric antigen receptor (CAR).

5. The modified cell of claim 1, wherein the modified cell further comprises an amino acid sequence encoding a CD19 chimeric antigen receptor (CAR).

6. The modified cell of claim 1, wherein the cell is a T-cell.

7. A pharmaceutical composition comprising the modified cell of claim 1 and a pharmaceutically acceptable carrier.

8. A nucleic acid molecule comprising a first polynucleotide, wherein said first polynucleotide encodes an effector module, wherein said effector module comprises:
   (a) a payload of interest, said payload comprising a membrane-associated Interleukin 12 (IL 12), wherein the membrane-associated IL 12 is a fusion protein comprising IL 12 subunit beta (p40), IL 12 subunit alpha (p35), at least one linker, and a transmembrane domain; and
   (b) a stimulus response element (SRE) comprising a region of hPDE5 corresponding to amino acids 535-860 of SEQ ID NO:1, wherein the region further comprises mutation R732L; and wherein the SRE is responsive to or interacts with at least one stimulus.

9. The nucleic acid molecule of claim 8, further comprising a second polynucleotide that encodes a CD19 chimeric antigen receptor (CAR).

10. A vector comprising the nucleic acid molecule of claim 8.

11. The vector of claim 10, wherein the vector is a plasmid or lentiviral vector.

12. A method of producing a modified cell comprising introducing into a cell:
   (i) a nucleic acid molecule comprising a first polynucleotide encoding an effector module, wherein said effector module comprises:
      (a) a payload of interest, said payload comprising a membrane-associated Interleukin 12 (IL12), wherein the membrane-associated IL 12 is a fusion protein comprising IL 12 subunit beta (p40), IL12 subunit alpha (p35), at least one linker, and a transmembrane domain; and
      (b) at least one stimulus response element (SRE) comprising a region of hPDE5 corresponding to amino acids 535-860 of SEQ ID NO:1, wherein the region further comprises mutation R732L; and wherein the SRE is responsive to or interacts with at least one stimulus.

13. The method of claim 12, further comprising introducing into the cell a second polynucleotide encoding a CD19 chimeric antigen receptor (CAR).

14. The method of claim 12, wherein the effector module is a bicistronic effector module that comprises the payload of interest and the at least one SRE, and an amino acid sequence encoding a CD19 chimeric antigen receptor (CAR).

15. A method of regulating expression of an immunotherapeutic agent in a cell, comprising introducing into a cell:
   (i) a first polynucleotide encoding an effector module, wherein said effector module comprises:
      (a) a payload of interest, said payload comprising a membrane-associated Interleukin 12 (IL12), wherein the membrane-associated IL 12 is a fusion protein comprising IL 12 subunit beta (p40), IL12 subunit alpha (p35), at least one linker, and a transmembrane domain; and
      (b) at least one stimulus response element (SRE) comprising a destabilizing domain (DD), wherein said DD is comprising a region of hPDE5 corresponding to amino acids 535-860 of SEQ ID NO:1, wherein the region further comprises mutation R732L PDE5; and wherein the SRE is responsive to or interacts with at least one stimulus; and
   (ii) optionally a second polynucleotide encoding a CD19 chimeric antigen receptor (CAR);
   wherein the DD is stabilized in the presence of a stimulus and enables expression of the membrane-associated Interleukin 12 (IL 12), and wherein expression of the membrane-associated Interleukin 12 (IL12) in the cell is significantly increased in the presence of the stimulus as compared to expression of the membrane-associated Interleukin 12 (IL12) in the absence of the stimulus.

16. The method of claim 15, wherein the cell is a T-cell.

17. The method of claim 15, wherein the stimulus is vardenafil, sildenafil or tadalafil.

18. The modified cell of claim 1, wherein the effector module comprises SEQ ID NO:620, 621, 663 or 665.

* * * * *